United States Patent 11,098,302 (IDENTIFICATION OF POLYNUCLEOTIDES ASSOCIATED WITH A SAMPLE) - sequence listing, part 115

SEQ ID NO: 397150 - DNA, 535 bp, Homo sapiens
  misc_feature: GZ8MTXP01C6HWB.3.79.H02.1.454.CMB.2.raw
  modified_base (245)..(245): a, c, t, g, unknown or other
  modified_base (295)..(295): a, c, t, g, unknown or other
  modified_base (322)..(322): a, c, t, g, unknown or other
  modified_base (364)..(364): a, c, t, g, unknown or other
  modified_base (398)..(398): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcacatctcctgcactggaaccaacagtgacgttgtatttttanatctctgtctctgtacaacaacaccagcaaagccccaaactcatcattangatgtcatgctcgccctctagggttcncatcgccttttctggctccaagtctggcaccacggcctcccngaccatcgtcgggctccgagctgagacgagctgntattactgcacgctactatataacgaacgacgacacctactcgtcggttggttaggttgggtagggacgggaacgaacgtacgtcgttaccgttcgttacgtaacgacgaaccgacgcgttccgtcccgttccgtcg

SEQ ID NO: 397151 - DNA, 579 bp, Homo sapiens
  misc_feature: GZ8MTXP01EE4W9.3.79.H02.1.454.CMB.2.raw
  modified_base (247)..(247): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtacaacaacaccagcaaacgccccaaactcatcatttatgatgtcactgctcggccctcgtagggtttctcatcgtccttttctggctccaagtctggccaccgaccggccctccctcgaccagtccgtccggggctccgaggctggaggacgaggctgcttatacgtgccagggtctactaattacgaacgaaagggacgaccaaccacgttcgttaccggttgggttaagtttggggtggacgggtaacccaaagtcgtcgttacccgttccgttaggtccacgccccgtaaggccttccgtcccccgttgggtccc

SEQ ID NO: 397152 - DNA, 574 bp, Homo sapiens
  misc_feature: GZ8MTXP01CZN6X.3.79.H02.1.454.CMB.2.raw
  modified_base (247)..(247): a, c, t, g, unknown or other
  modified_base (252)..(252): a, c, t, g, unknown or other
  modified_base (327)..(327): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctntgtctctgtacaacacaccagcaaacgccccaaatcatcattatgatgtcactgctcggccctcgtagggtttcnctatcgtccttttctggctcaagtctcggcaccgacggccctccctgaccctatccgtcggggctccgaggctggaggacgagggtctgcttatactgccaggtctataatataacgaaaggacaccaaccgctcgttccggtggttaacgtttggggtagggacgggtaacccaaggtcgtacggttacccgttcgttaagggtccacggaaccccgaaggtccttaccggtcccccgttggtccc

SEQ ID NO: 397153 - DNA, 564 bp, Homo sapiens
  misc_feature: GZ8MTXP01AOS7G.3.79.H02.1.454.CMB.2.raw
  modified_base (248)..(248): a, c, t, g, unknown or other
  modified_base (253)..(253): a, c, t, g, unknown or other
  modified_base (289)..(289): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctntgtctctgtacacaacaccagcaaacgccccaaacncatcatttatgatgtcactgctcggccctcgtagggtttctctatcgtccttttctggctccagtctggccaccaccggccctccctgaccatcccgtcggggcctccgaggccgtggacgggacgacgggctcgtcttacttactgacacggctacataactaaccaaggcacacctactctcggttgtagttgggtgggttagggaacccgagtccgtcgttacccgttcgttacgggtccacgcccgaaggccttccgccccgttcgtcccg

SEQ ID NO: 397154 - DNA, 520 bp, Homo sapiens
  misc_feature: GZ8MTXP01BU4DL.3.79.H02.1.454.CMB.2.raw
  modified_base (299)..(299): a, c, t, g, unknown or other
  modified_base (437)..(437): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctgtaccaacacaccagacaaacgccccaaactcatcatttangatgtcactgctcggccctcgagggtttctcatcgtccttttctggtctccaagtctggcaccacggcctccctgaccatctcggggctccgaggctgacggacgaggctgcttatactgcaggctcatatacaggancaccatctcgtgtcgttggtggagggtaccagcgtgacccgttcgttacggtcacgcccgaaggccttcggccccgttggtcc

SEQ ID NO: 397155 - DNA, 513 bp, Homo sapiens
  misc_feature: GZ8MTXP01A0D6L.3.79.H02.1.454.CMB.2.raw
  modified_base (244)..(244): a, c, t, g, unknown or other
  modified_base (394)..(394): a, c, t, g, unknown or other
  modified_base (416)..(416): a, c, t, g, unknown or other
  modified_base (490)..(490): a, c, t, g, unknown or other
  modified_base (499)..(499): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtacaacacaccagcaaagccccaaatcatcatttatgatgtcactgctcggccctcaggggtttctcatcgtccttttctggtctccaagtctggcaccacggcctccctgaccatcctcggggctccgaggctggnggacggagctgcttatactgcncggctcatataacaaggcgcaccactcgtcgtggttattgggtggacgggtacagctgaccgttcgttaggtcncgccaggcncgtcccgttcgtcc

SEQ ID NO: 397156 - DNA, 533 bp, Homo sapiens
  misc_feature: GZ8MTXP01CCD9Z.3.79.H02.1.454.CMB.2.raw
  modified_base (246)..(246): a, c, t, g, unknown or other
  modified_base (301)..(301): a, c, t, g, unknown or other
  modified_base (345)..(345): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctctgtctctggtaccaacaacaccaggcaaacgccccaaactcatcatttangatgtcactgctcggccctcgaggggtttctcatcgccttttcnggctccaagtctggccaccacggcccttccctgaccatcgtcggggctccaggctgacggacgagctgcttatactgcaggctcaatatacaaggcacacactctcgtgtagtttgggtggaggtaccaagtcgtgacccggttcttacggtcacgtcccaaggtccttcgtcccccgttggtaaccc

SEQ ID NO: 397157 - DNA, 569 bp, Homo sapiens
  misc_feature: GZ8MTXP01DQ7R1.3.79.H02.1.454.CMB.2.raw
  modified_base (250)..(250): a, c, t, g, unknown or other
  modified_base (351)..(351): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtacaacaacaccagcaaacgccccaaactcatcatttatgatgtcactcgctccggccctcgtaggggtttctcgatcgtccttttcnggtctccaacgtctcggcaccacggccctccctgaccatccgtcggggctccgaggctcgaggacgaggctgtcttattacttcagtctactaatataacgaaaggacaccaccacttcgtcggttggttaagttgggtaagggaacgggacctaaagcgtcgaccgttacgttggttcaacgcccgaaggtcctccgccccgtcggttaacgtcccg

SEQ ID NO: 397158 - DNA, 731 bp, Homo sapiens
  misc_feature: GZ8MTXP01AIKD8.3.79.H02.1.454.CMB.2.raw
  modified_base (248)..(248): a, c, t, g, unknown or other
  modified_base (350)..(350): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaaccaacagtgtacgttgtatttttanatctctgtctctgtacaacacaccagacaaacgccccaaatcatctattatgatgtcactcgctccggccctcgtaggggtttctctacttcgtccttttcnggtcctaccgaagttccgttcgggccctacccgacccggtcccttaccccgtacgaccctacgttcccggtccgggggtccttaccggacgggtcgtaggacgggtacgacgggtccttaggtacctttacgttaacgtcgtaccgtacgggtaccttacgtaacttaaacgtaacgaaacggtccgaacctaacccgtaaccgtttccggttaccgggtttaacgggtttagggtttaacgggggtaacgggttaaccggggtaaaccgttaacggttacccggtacgggttaaccccggttcggttaaccgggtcccgtaacccgggcccggtaaaccggtcccggttccccgttaaccccgttcccgggtttaacccc

SEQ ID NO: 397159 - DNA, 549 bp, Homo sapiens
  misc_feature: GZ8MTXP01C9Y2T.3.79.H02.1.454.CMB.2.raw
  modified_base (249)..(249): a, c, t, g, unknown or other
  modified_base (254)..(254): a, c, t, g, unknown or other
  modified_base (425)..(425): a, c, t, g, unknown or other
  modified_base (441)..(441): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctntgtctctggtacaacaacaccagcaaagccccaaactcatcatttatgatgtcactgctccggccctcgtagggtttctcatcgtctttctggctcagtctgcaccacgcctcctcacactcgtcgggtctccgtaggctgaggacgaggtctgtcttatactgcaggctnaatataacgaaggacncctacctacttacgtcggtaggttaggtttaaggtgggttaacggacgaagcgtcggaccgttcgttacggtcacgtcccgaagggccttcgtcccccgttggtcccc

SEQ ID NO: 397160 - DNA, 518 bp, Homo sapiens
  misc_feature: GZ8MTXP01DV1NX.3.79.H02.1.454.CMB.2.raw
  modified_base (229)..(229): a, c, t, g, unknown or other
  modified_base (249)..(249): a, c, t, g, unknown or other
  modified_base (290)..(290): a, c, t, g, unknown or other
  modified_base (300)..(300): a, c, t, g, unknown or other
  modified_base (346)..(346): a, c, t, g, unknown or other
  modified_base (446)..(446): a, c, t, g, unknown or other
  modified_base (504)..(504): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaanagtgacgtttgtatttttanatctctgtctctgtacaacaacaccagcaaacgccccaaancatcatttangatgtcactgctccggccctcgtagggtttctcatcgtccttttcnggtctccaatctggcaccacggccctccctgacccatccgtcgggctccaggcctgaggacgagctgtcttattactgccagctcaatactaacaaggancaaccactctcgtgttagttggtggagggacagctgaccgttcaggtcagccgaagcncgccccgttgtccc

SEQ ID NO: 397161 - DNA, 682 bp, Homo sapiens
  misc_feature: GZ8MTXP01CWQOD.3.79.H02.1.454.CMB.2.raw
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctgtacaacaacaccagacaaacgccccaaactcatcatttatgatgtcactgcctccggtccctcggtacgggtttctctacttccgtccctttttctcggtccttacccgtaacgttccgttcgggcccacccgaccgggtccccttccccgtacgaccctacgttcccggtccgggggtcccttccggaacgggtccgtagggaacgggaacggtacgggtcttacggtactttacttacgttgacctaggtctaactaattaacgaacgaaacggcgtacctaacccgtacttccgttacggttggttaacgtttggggacgggttaacggggacccaaagggtccgtcggttacccgttcgttacggtaaccgaccgtcccgaacggtcccgttacccggtcccccgttaacggtcccc

SEQ ID NO: 397162 - DNA, 536 bp, Homo sapiens
  misc_feature: GZ8MTXP01CZ713.3.79.H02.1.454.CMB.2.raw
  modified_base (247)..(247): a, c, t, g, unknown or other
  modified_base (350)..(350): a, c, t, g, unknown or other
  modified_base (379)..(379): a, c, t, g, unknown or other
  modified_base (411)..(411): a, c, t, g, unknown or other
  modified_base (428)..(428): a, c, t, g, unknown or other
  modified_base (453)..(453): a, c, t, g, unknown or other
  modified_base (465)..(465): a, c, t, g, unknown or other
  modified_base (471)..(471): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtacaacaacaccagcaaacgccccaaatcatcatttatgatgtcactgctccggccctcgtagggggtttcctcgattccgtccttttcnggtctccaagtctggcacacggcctcccngaccatcgcggggctccgaggctggaggacgnggctgccttatactgcnggctacattacacaaggcacaaccntcgtcgtggttnttgggnggttagggaccaagtctgaccgttcttaggtcacgtccgaaggccttccgtccccgttcggtccc

SEQ ID NO: 397163 - DNA, 769 bp, Homo sapiens
  misc_feature: GZ8MTXP01BHKTY.3.79.H02.1.454.CMB.2.raw
  modified_base (246)..(246): a, c, t, g, unknown or other
  modified_base (300)..(300): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtaccaacacaccagacaaacgccccaaactcatctatttangatgtcactgccgtccggccctcgtacggggtttctactacttccggtccttttcgtcggtcctacccgtaacgttcctcgggcccaacccgtaacccgggtccccttccccgtacggtacccctaacgttcccggtccgggggcccttaccggaacgggccgttacgggaaacggggaaccggtacgggtaccgttcgggtaccttttaaacgttaacccgttgggaccctaacggggtacccgtttaacgtaaacttaaacgttaaaaccggaaaaccggggtaccgaacccgtaaacccctaacgtttccccggttacgggtttacggggtttaaaggttttgggggttaacgggggaaacggggtaacccaaagggtccgtaacgggttacccggttcgttaacggggtaaccaccggaaccccgaacgggtcccttacccggtcccccggttgggttaaccccg

SEQ ID NO: 397164 - DNA, 793 bp, Homo sapiens
  misc_feature: GZ8MTXP01CF9CX.3.79.H02.1.454.CMB.2.raw
  modified_base (242)..(242): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctccctccgcgtccgggtctcctggacagtcagtcaccatctcctgcactggaaccagcagtgactattggtnattataactatgtctctggtaccagcagcaccaggacaaacgccccaaactcatcatttatgatgtcactgctcggcccttcgtaggggtttctctacttcgttcttttcgtcggtccttaccctaagttccgtacggccaacccgacccggtcccttaccccgtacgtaccctacgttccgtccgggggcccttccgaacgggtccgtacgggaacggggaacggacgggtccgttacggtaccgtttaactttaacgttcggggaccctaacggtacccttaaccgtaaattaaacgttaaacccgtaaaaggggtaacccgtaacccgtaaacccctaacccgtttccggttaacccgggtttcgggggtttttaaaagtttttcggggggtttaaacgggggaaaccgggggttaaaccccgtaaaacgggttcccggttacccggttaaaccccggtttaaccccgggttaaacgggttaacccggaaaacccgggttcccccgaaaacggggttccccgttccccgggtttaacccccccccggg

SEQ ID NO: 397165 - DNA, 619 bp, Homo sapiens
  misc_feature: GZ8MTXP01CPAPW.3.79.H02.1.454.CMB.2.raw
  modified_base (230)..(230): a, c, t, g, unknown or other
  modified_base (249)..(249): a, c, t, g, unknown or other
  modified_base (333)..(333): a, c, t, g, unknown or other
  modified_base (350)..(350): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaaccaangtgacgtttgtatttttanatctctgtctctgtacaacacaccagacaaacgccccaaactcatctattatgatgtcactgcctcggccctcgtagggtttcnctatcgtcccttttcgnggtctccaagtctcgccaccacggccctccctgaccgtactccgtccggggctccgacgggccgtaggacgggacgtaggcgtacggtcttatacgtcgcaggctacattacaacgaacggaacgaccaaccgtaacttccgtacggtttacggttaaggttcggggttaagggacggggaacccttaaaggtcccgtaacggttacccgttcgttaccggtaacaacggccccgaagggtcccttcccggtccccgttccgggttccc

SEQ ID NO: 397166 - DNA, 563 bp, Homo sapiens
  misc_feature: GZ8MTXP01D7KMV.3.79.H02.1.454.CMB.2.raw
  modified_base (251)..(251): a, c, t, g, unknown or other
  modified_base (307)..(307): a, c, t, g, unknown or other
  modified_base (338)..(338): a, c, t, g, unknown or other
  modified_base (350)..(350): a, c, t, g, unknown or other
  modified_base (359)..(359): a, c, t, g, unknown or other
  modified_base (374)..(374): a, c, t, g, unknown or other
  modified_base (378)..(378): a, c, t, g, unknown or other
  modified_base (381)..(381): a, c, t, g, unknown or other
  modified_base (410)..(410): a, c, t, g, unknown or other
  modified_base (442)..(442): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgtttgtattttttanatctctgtctctgtaccaacaacacccaggacaaacgcccccaaatcatcatttangatgtcactgctccggccctcgagggtttcncatcgtctttcngctccatcngcaccacgccctccngacntcncgggctcagctgagacgagctgcttatcngcaggtctctaatactaacgaaaggcacaccncttacgtcgttaggttgtttaaggggtcggaacgggaccttaaagcgttacggttaccccgttcgttaacggttcccgacggccccgaaggcccgttccgtccccccgttcggtaaccccg

SEQ ID NO: 397167 - DNA, 548 bp, Homo sapiens
  misc_feature: GZ8MTXP01CAOWP.3.79.H02.1.454.CMB.2.raw
  modified_base (229)..(229): a, c, t, g, unknown or other
  modified_base (248)..(248): a, c, t, g, unknown or other
  modified_base (300)..(300): a, c, t, g, unknown or other
  modified_base (346)..(346): a, c, t, g, unknown or other
  modified_base (485)..(485): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaanagtgacgttgtatttttanatctctgtctctgtacaacacaccaggcaaacgccccaaactcatcatttangatgtcactgctcggccctcgaggggtttctctatcgtccttttcnggctccaagtctcgggtcaccgacgggtccctcccgtgaccatcgtcggggctccgaggctggaggacgaggctgcttatactgcaggctcaatagtaacgaagggcaccaccgtactcttcggtggttagtttggggnggagggaccagcgtcgacccgttccgttaggtcacgcccgagccttcgtccccgttcggtccc

SEQ ID NO: 397168 - DNA, 620 bp, Homo sapiens
  misc_feature: GZ8MTXP01CYT6U.3.79.H02.1.454.CMB.2.raw
  modified_base (538)..(538): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgtacgttgtattttatatctctgtctctggtaccaacaacaccagcaaacgcccccaaactcatcatttatgatgtcactgctccggtccctcgtagggggtttctcgtatccgtccttttcgtcggtcttacccgtaaagttcctcgggcctaaccccgaccgggtcccctccccgtacgaccctactcccgtccgggggtccttacccggacggcgtaggacgggacggaggtctggtcttattactgcaggtctacgattataacgaaggacacaccctacttcgtcgttggttagtttgggnggttacgggaccaggtcgtggttacccgttcgttacggtccgacgcccgtaaggccgttaccgtcccccgttcgggttcccc

SEQ ID NO: 397169 - DNA, 560 bp, Homo sapiens
  misc_feature: GZ8MTXP01E3R6B.3.79.H02.1.454.CMB.2.raw
  modified_base (249)..(249): a, c, t, g, unknown or other
  modified_base (454)..(454): a, c, t, g, unknown or other
  modified_base (490)..(490): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtattttttanatctctgtctctgtaccaacaacaccagacaaacgccccaaatcatcattatgatgtcactcgctccggccctcgtagggtttctcattcgtccttttctggctccaagtctcggccaccgaccggtccctccctgaccagtcgtcggggctccgagggtctaggacggacgaggtcctgtacttatactgcaggtctacaatanacgaaggcactaccactcgtcgtaggttatttgggnggacgggaccaagctacgaccgttcgttacggtccgacgcccgaacggccttccgtccccgttcggtccc

SEQ ID NO: 397170 - DNA, 604 bp, Homo sapiens
  misc_feature: GZ8MTXP01A8ETF.3.79.H02.1.454.CMB.2.raw
  modified_base (246)..(246): a, c, t, g, unknown or other
  modified_base (333)..(333): a, c, t, g, unknown or other
  modified_base (478)..(478): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaccaacagtgacgttgtatttttanatctctgtctctgtaccaacaacaccaggacaaacgccccaaactcatcatttatgatgtcactgctccggccctcgtagggtttcnctatcgtccttttctggtctcctagtctcggccaccaccgggtccctcccgtcgacctagtccgtcggggtctccgaggccgtaggaggacgaggtaccttacgttacttacgtgacacgcgtactagtaacgtaacgaaggacncctaacctacttccgttggtacggttagtttggggaaggtaacgggacaaacgcgtacggtaccgttccgttaggttaccgaacggacccgaacggtccctccggcccccgtaacggttcctcccg

SEQ ID NO: 397171 - DNA, 573 bp, Homo sapiens
  misc_feature: GZ8MTXP01CAMNH.3.79.H02.1.454.CMB.2.raw
  modified_base (249)..(249): a, c, t, g, unknown or other
  modified_base (284)..(284): a, c, t, g, unknown or other
  modified_base (457)..(457): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgtttgtatttttanatctctgtctctgtaccaacaacaccaaggaaacnccccaaatcatctatttatgatgcactgctcgccctgtagggtttctcatcgtctttcctggtctaccaagtctacgggccaacccgaccggccctcccgtcgaaccctacgtccgtcggggcctccgaggcgtaggacggacgaggtctgcttatactgcagctactataanacgaagcacacctacgtcgtcgtgttagtgggtaaggaacggacaagcgtacgtaccgttcgttaacggcgaacgacccgaacggtccgtcccgttccccgtcgttccgtaacccg

SEQ ID NO: 397172 - DNA, 550 bp, Homo sapiens
  misc_feature: GZ8MTXP01ARM6J.3.79.H02.1.454.CMB.2.raw
  modified_base (248)..(248): a, c, t, g, unknown or other
  modified_base (303)..(303): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccaacaacaccaggacaaacgccccaaactcatcatttangatgtcactgctcggccctcgagggtttctctatcgtcctttctggtctccaagtctcggccaccaccggcctccctgaccagtccgtcggggctcgaggcgtggaggacgagggctgtcttatactgtcaggctacaatactaacgaagacgccacctactcgtcgttggttcgttgggtgggttacggacaggctcggaccgttcgttaggcacgcccgaggccgttccgtccccgttcgtcccg

SEQ ID NO: 397173 - DNA, 556 bp, Homo sapiens
  misc_feature: GZ8MTXP01A8T88.3.79.H02.1.454.CMB.2.raw
  modified_base (247)..(247): a, c, t, g, unknown or other
  modified_base (299)..(299): a, c, t, g, unknown or other
  modified_base (345)..(345): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaccaacagtgacgttgtatttttanatctctgtctctgtaccaacaacaccagcaaacgccccaaatcatctattangatgtcactgctccggccctcgtagggtttctcatcgtcctttcgngtctaccaagtctcggccaccgtaccggccctccctgaccacgttccgtccggggcctccgaggctggacggacgaggctgtacttatactcgctaggctacaattacgaacgaaggacactaacctctacgtcgttggttagttgggtggacgggacagcgtcgaccgttcgttagtcgacgccgaggccttccgtccccgttcggtccc

SEQ ID NO: 397174 - DNA, 550 bp, Homo sapiens
  misc_feature: GZ8MTXP01A3LBZ.3.79.H02.1.454.CMB.2.raw
  modified_base (247)..(247): a, c, t, g, unknown or other
  modified_base (252)..(252): a, c, t, g, unknown or other
  modified_base (330)..(330): a, c, t, g, unknown or other
  modified_base (470)..(470): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctntgtctctgtaccaacacaccagacaaacgccccaaatcatcatttatgatgtcactgctccggcctcgtagggtttcnctactcgtccttttcgtggtcctaccgaagtctcggccacccgaccggtcccctccctcgaccctagtccgtccggggccttccgaggtcgtaggaggaccggaggtctggtcttatactgcaggctacatatacgagcncacactcgtcgtgtagttggtggacgggtacagcgtcgccgttcgacggtcacgcccgaggccttccgccccgttgtccc

SEQ ID NO: 397175 - DNA, 589 bp, Homo sapiens
  misc_feature: GZ8MTXP01CDAWE.3.79.H02.1.454.CMB.2.raw
  modified_base (304)..(304): a, c, t, g, unknown or other
  modified_base (353)..(353): a, c, t, g, unknown or other
  modified_base (477)..(477): a, c, t, g, unknown or other
  modified_base (510)..(510): a, c, t, g, unknown or other
  modified_base (564)..(564): a, c, t, g, unknown or other
tcagagacgcactccacgaccggtgctcgatttagtgtcacacgaagggaaaggggggggtctcaggaggcagcgctctcgggacgtctccaccatggcctgggctttgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctggtacaacaacaccagcaaacgacccccaaactcatcatttangatgtcactgctcggcccttcgtaggggtttctctattcgtcttttccnggtctcaagtctggccaaccgacggtccctccctcgacctacgtcgtccggggccgtccgggcgtacggacgggacggaggtctcgtcttagttactgcagctcgaataactaacgaacggganccaaccctactccgttgtcggttaagtttgggngggaacgggacaaggtcgttcggaccgttcgacggttcacggtcccaaggtccncgtccccgcggtccaacgtttcccg

SEQ ID NO: 397176 - DNA, 782 bp, Homo sapiens
  misc_feature: GZ8MTXP01CR6Q9.3.79.H02.1.454.CMB.2.raw
  modified_base (248)..(248): a, c, t, g, unknown or other
  modified_base (253)..(253): a, c, t, g, unknown or other
  modified_base (300)..(300): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaaccaacagtgtacgttgtatttttanatctntgtctctgtaccaacaacaccagacaaacgcccaaactcatcattangatgtcactcgccgtcggtcccgtcgtacgggggtttcctctagttccgtcctttttcgcggttcctacctaagttcccgttcgggcccacccgtaaccgggtcccttaccccgtacgaaccctacttcccggtcccgggggtcctacccgaacggggtccgttacggaacggggaaccggaacgggtccgtcgggtaccctttaaagttaccgttcggaccctaagggtccccgttaactaaatttaaaacgtaaaccgaaacgggtaaaccggtacccaaaccccgtaaccgttccgtttaccgggttagggtttaagggttttaaggggttaacggggttaaaccggggggtaaacccaaacgggtcccgttacgggaaaccccggtttcccggttaacgggttaaccccgtaacgggaacccccggttaaaacgggccccgttaaccccggtccccccggttccgggtttaacccccg

SEQ ID NO: 397177 - DNA, 522 bp, Homo sapiens
  misc_feature: GZ8MTXP01CN0Y9.3.79.H02.1.454.CMB.2.raw
  modified_base (246)..(246): a, c, t, g, unknown or other
  modified_base (298)..(298): a, c, t, g, unknown or other
  modified_base (328)..(328): a, c, t, g, unknown or other
  modified_base (340)..(340): a, c, t, g, unknown or other
  modified_base (423)..(423): a, c, t, g, unknown or other
  modified_base (435)..(435): a, c, t, g, unknown or other
  modified_base (451)..(451): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctctgtctctggtaccaacaacaccagcaaagccccaaatcatcatttangatgtcactgctcggccctcgagggtttcncatcgcttttcnggctccagtctggcaccacggcctccctgaccatcgtcggggctccgaggctggaggacgagggctgcttatactgcaggctnatatacaaggcncacactctcgtggttnttgggtgagggaccaagcgtgacccgttcttacgggtcagtcccaagggcttacgcccccgttggtaaccc

SEQ ID NO: 397178 - DNA, 575 bp, Homo sapiens
  misc_feature: GZ8MTXP01ARUSF.3.79.H02.1.454.CMB.2.raw
  modified_base (248)..(248): a, c, t, g, unknown or other
  modified_base (450)..(450): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctcctggtaccaacaacaccagcaaagcccccaaatcatcatttatgatgtcactgctcggccctcgtagggtttctcatcgtcctttctggctcagtctgcaccacgcctccctgaccatccgtcggggctccgaggccgtggacggacggaggtctgtcttagtactgcaggctacataactaacgaagganaccaacctactccgtacgttggttagtttgggtaggttacgggaccaagtccgtacggttacccgttccgttacgggttccaccggcccgtaacggccgttccgtcccccgttcgggttaacccc

SEQ ID NO: 397179 - DNA, 649 bp, Homo sapiens
  misc_feature: GZ8MTXP01CRLQ3.3.79.H02.1.454.CMB.2.raw
  modified_base (228)..(228): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagggtcctgggcccagtctgccctgactcagcctccctccgcgtccgggtctcctggacagtcagtcaccatctcctgcactggaaccngcagtgactattgggtataattataactatgtctctggtaccagcagcacccaggaccaaacgcccccaaatcaatgtaactttatgaggtacaacgaaacggccggccctcgacgggggtcctgatcgtcttcctctcgcctcaagtctacggcaaccgacggtccctcccgtacgtaccgttctcgtcgggtcctccgacgccgtaggaggatggaggtctaggtattattactgcgtacgtctacatatcgcgacggctaactctaaacgtcggtttcgggtttaaccgggacggggttaacgggtaaccgttaacggtaccgttacggttaacccggttcccggttaacggggtaacccgaacccggtaacccggtaaccgggtccgttccccgggtcccccgttcccgggttcccc

SEQ ID NO: 397180 - DNA, 521 bp, Homo sapiens
  misc_feature: GZ8MTXP01D0C3L.3.79.H02.1.454.CMB.2.raw
  modified_base (248)..(248): a, c, t, g, unknown or other
  modified_base (253)..(253): a, c, t, g, unknown or other
  modified_base (440)..(440): a, c, t, g, unknown or other
  modified_base (455)..(455): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctntgtctctgtaccaacaacaccaggcaaacgccccaaactcatcatttatgatgtcactgctcggccctcgtagggtttctcatcgtcctttctggctccaagtctgccaccacggccctccctcgaccatcgtccgggctccgaggctggagacgaggctgcttatactgcaggctcatatacaagngcacactctcgtgtnttggtggacggacagctgaccgttcgacgtcacgccgaacggcttaccgtccccgttcgtaacccg

SEQ ID NO: 397181 - DNA, 714 bp, Homo sapiens
  misc_feature: GZ8MTXP01E1TZI.3.79.H02.1.454.CMB.2.raw
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtattttttatatctctgtctctgtaccacacaccagcaacgcccccaaactcatcattatgatgtctactcgtccgtcccggtccctcggtacgggtttctaccgtatcgtccttttacgtcgtcctaccgaacgtcgtaccggccctacccgacccgggtccctacccgtcgacccgtacgtccggttccggggcctaccggacggacgtacggacgggacgtaggtacctacgtacttacgtacgtcgacgtacggtctaactaacgttaaccgaacgaaccggtaccgtacccgtaccgttccggttacggttacgggttacgggttacgggtaacggggtaaaccgggaccggtaaaccgttaccgtacccggtaccccgttacccgttaacccggttaccggtaaccccgacccggtaacccgtccccgggtccccgttccccgtaaccccgttaacccgttcccccgg

SEQ ID NO: 397182 - DNA, 514 bp, Homo sapiens
  misc_feature: GZ8MTXP01A7UQJ.3.79.H02.1.454.CMB.2.raw
  modified_base (329)..(329): a, c, t, g, unknown or other
  modified_base (412)..(412): a, c, t, g, unknown or other
  modified_base (431)..(431): a, c, t, g, unknown or other
  modified_base (436)..(436): a, c, t, g, unknown or other
  modified_base (455)..(455): a, c, t, g, unknown or other
  modified_base (499)..(499): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacaccaggcaaagccccaaatcatcatttatgatgtcactgctcggcctcgagggtttcncatcgtctttctgctcaagtctggcaccacggccctcctgaccatcgtcggggctccaggctgaggacgaggctgcttatacngtcagctcatatacaaggncaccnctcgtcgtggtatttgggnggttagggaccagctcgaccgttcttaggtcagcccgaaggtcncgtccccgttggtcc

SEQ ID NO: 397183 - DNA, 607 bp, Homo sapiens
  misc_feature: GZ8MTXP01EHBI3.3.79.H02.1.454.CMB.2.raw
  modified_base (248)..(248): a, c, t, g, unknown or other
  modified_base (300)..(300): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcaatggaaccaacagtgacgttgtatttttanatctctgtctctgtacaacaacaccagcaaacgccccaaactcatcatttangatgtcactgctcgcctcgtagggtttctctatcgtcccttttactggctcagtctcggcaccgacggccctcccgtacgaccagtccgtacggggtctaccgacgccgtggaaggtatggacggtctagtacttattacgtcgtacacgtctcatacgtgacgaggactataccaaacgtcgtttgggttttccggacgggttaagggtacccttaaaggccgttacggacccggttccgtttaagggaacccacgaaccccgttaaacgggccgttacccgtccccccggttcgggttaaccccg

SEQ ID NO: 397184 - DNA, 716 bp, Homo sapiens
  misc_feature: GZ8MTXP01A7CXM.3.79.H02.1.454.CMB.2.raw
  modified_base (247)..(247): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtaccaacaacacccagacaaacgacccccaaactcaatctatttatgatgtcactgctccggccctcgtagggtttctctactcgtcccttttccgtggtcctccgtaacgttccgtacgggcctaacccgacccgggtccccttaccccgtacgaaccctacgttcccggtaccgggggtccttacccggagggtcccgtagggaacggggtaccggagggtccgttggtaacctttacttaccgtgtacccgtaagggtccttactaaacttaacgtaaaccgaaagggtaccgtaaccgaaccctacgttccgttaccgggttgggtttaaggtttggggtaacggggacgggaacccgttaaaggtcccgtacggaccccggttccgttacgggtccgaacccgtaacccggaacggtcccttccccggtaacccccgttcgggttaacccc

SEQ ID NO: 397185 - DNA, 745 bp, Homo sapiens
  misc_feature: GZ8MTXP01BEG39.3.79.H02.1.454.CMB.2.raw
  modified_base (249)..(249): a, c, t, g, unknown or other
  modified_base (337)..(337): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccaacaacaccagcaaacgcccccaaactcatcatttatgatgtcactgcctccggccctcgtacgggtttcnctatcgtcctttctggcctccaagtctcgggtcccacccgaccgggtcccctcccgtacgacccgtacgttcccggtcccgggggtcctacccggaacgggtccgttagggaaccggggaaccgggtaacgggttccgttacggttacctttaacgtttaaccgtggtacctacggggtaccttacgtaaacttaacgttaaaccgaaacggacgaccctaacccgtaaccgttcccgttagggttacgggtttaggtttaaggggtcggggttaaacggggtacccgttaaacggtccggtaaccggttaccccggttccggttaccggggttaacccgtaccgggtaaccccgaaacggggtccccgttaccccgggttcccccccggtttccgggttaacccccg

SEQ ID NO: 397186 - DNA, 724 bp, Homo sapiens
  misc_feature: GZ8MTXP01BQFVK.3.79.H02.1.454.CMB.2.raw
  modified_base (248)..(248): a, c, t, g, unknown or other
  modified_base (253)..(253): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctntgtctctgtacaacacaccagacaaacgcccaaatcatcattatgatgtacactcgcgtccggccctgtacggggtttctcgtactccggttcctttcgtacggtccctccgaaacgttccttacgggcccacccgaacccgggtcccctaccccgttaccggaacccctaacgttcccggttacccgggggtcctaccgtaacgggggcccttaggaacggggtaaaccggacgggtcctaggtacctttaaactttccgacggttaccaggggtaccctttacgtaaatttaacgtaaacgaaaacggggtcgtaacccgaaacccgtacctaccggtttaaccggttacggttaggttttaaccggggttgggaaacgggggtaccccaaaggtccgttacggacccgttcccggttaggtcccgacgtaacccgaacgtccgttacccgcccccgttgggttccccg

SEQ ID NO: 397187 - DNA, 610 bp, Homo sapiens
  misc_feature: GZ8MTXP01EHCMM.3.79.H02.1.454.CMB.2.raw
  modified_base (253)..(253): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactcgaaccaacagtgacgttgtatttttatatctntgtctctgtacaacacaccagcaaacgaccccaaactcatcatttatgatgtcactgcctcggcctcgtagggtttctcatcgtcctttctggtctcacgtctcgcaccgacgccctcccgtcgaccacgttcgtcgggtcctccgacggcgtggacggacggaggtcgtacgtcttacgttacttgctacggtcttactataagtaacgaaggacaccaaccgtacttcgttaccggttggttaggtttcggggtagggttacggggtaacccaaaggtcgtaacgggaccccgttcgttacggtcgaccgaaccccgtaacgggtcccttccggtcccccgttcggttaaccccg

SEQ ID NO: 397188 - DNA, 614 bp, Homo sapiens
  misc_feature: GZ8MTXP01BKHAF.3.79.H02.1.454.CMB.2.raw
  modified_base (250)..(250): a, c, t, g, unknown or other
  modified_base (393)..(393): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgtttgtatttttanatctctgtctctggtaccaacaacaccagacaaacgccccaaatcatctatttatgatgtcactgctccgtcctcgtagggtttctcattcgtcctttcgtgtcctcaagttctcggccaccaccggccctcccgtcgacctntccgtcgggctccgagcgtaggacggacgaggtctgacttatactcgcacggtctactaaactacgtaaacgaacggacacacccgtacgttccgtacggttacggttaggtttcggggtacgggacgggtaaccaaaggtccgtacggttacccggttccgttacgggtaaccaccggtaacccgaacgggtcccgttcccgtccccgttcggttaaccc

SEQ ID NO: 397189 - DNA, 587 bp, Homo sapiens
  misc_feature: GZ8MTXP01EWRQF.3.79.H02.1.454.CMB.2.raw
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctgtacaacacaccagcaaacgccccaaactcatcattatgatgtcactgctccggccctcgtaggggtttctcatcgtccttttctggctccaagtctggccaccacgggtccctccccgtgaccatcgtcggggctccgaggctggaggacgaggctgtcttatactgcaggctacatataacgaagacgactaccgactccgttacgtggttagtttgggtcggggttaagggacccgttaaaggcgttcggaaccccggttccgttaagggtcccgacggcccgaacgggcccgttccggtccccccgttccgggttaaccccg

SEQ ID NO: 397190 - DNA, 685 bp, Homo sapiens
  misc_feature: GZ8MTXP01DDTB9.3.79.H02.1.454.CMB.2.raw
  modified_base (232)..(232): a, c, t, g, unknown or other
  modified_base (252)..(252): a, c, t, g, unknown or other
  modified_base (308)..(309): a, c, t, g, unknown or other
  modified_base (312)..(312): a, c, t, g, unknown or other
  modified_base (434)..(434): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcaggcacagagtcctgggcccagtctgccctgactcagcctgcctccgtgtcgtgggtctccgtggacagtcgatcaccatctcctgcacgtaggaaccaanagtgtacgttgtatttttanatctctgtctctagtaccaacacaccagacaaacgaccccaaactcatctatttannatntcatgctccgccgtcgtacgggtttctcgtatcgttccttttcgtcgtcctaccaacgttcgtacgggccacccgtaccgtccctcccgccgtacctacgtcccggttaccgggcctccggngggtctagggacgggacggtaacggtcgtacggttacctttataccgtcgaccgtaggggtacctaaccgtaattaacaacggaaacggcgacctacctacgtccgttaggtacggtttaggtttggggtaacgggttaacgggtaaccgttaacgtaccggtacggttaccccggttcgttaaccggggtccgtaacccgaacccggtaaccgggtccgttacccccgtccccggttaaccgttcccccg

SEQ ID NO: 397191 - DNA, 667 bp, Homo sapiens
  misc_feature: GZ8MTXP01CQLAS.3.79.H02.1.454.CMB.2.raw
  modified_base (230)..(230): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaanagtgtacgttgtatttttatatctctgtctctggtacaacaacaccagcaaacgccccaaatcatctatttatgtatcgtcactcgctccggtccctcgtacggggtttactcgattcgttcctttcgtcggtctaccgaagtccttggccacccgaccgtccctcctcgacctacgtccgtccggggtctccgaggtcgtaggacgggtacggacggctcgtacgtttactacgttcgtcgtaaggtcttacgtaataacgtaacgaacggacgacctaacccacttccgtcgttaggttaggtttggggttacggggaacgggtaacccgttaaacgggtaccgttacggttaccccggttccgttaccggttaaccggaccccgaacccggtaaccgtcccggttcccgtccccccggttccggttttcccccg

SEQ ID NO: 397192 - DNA, 792 bp, Homo sapiens
  misc_feature: GZ8MTXP01BDTF3.3.79.H02.1.454.CMB.2.raw
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctcctgtaccaacaacaccaggacaaacgaccccaaactcatactatttatgtatgtacactgcctccggccctcgtagggtttcctctacttccgtccttttctcggtccttaccgtaacgttcccgttacggcccaaacccgacccgggtcccctaccccgtacgaaccctacgttcccggtccgggggtacccttacccggacgggtccgtacgggaacggggtaaccgggtaacggggtaccttcgggttaacctttaacgtttaacccgtcggtaccgtaacgggggtacctttaaccgtaaacttaaacgttaaaaccggtaaacgggaaccgaacccgtaaacccctaaccgttccgtttacccgggttagggtttacgggttttaagggggtacggggttaaacggggtaaacccgttaaacggtccggttaacgttaccccggttccgttaacgggttaacccgacccggtaaccccggaacgggtccccgttaccccgggtcccccccgtttcgggttaacccccg

SEQ ID NO: 397193 - DNA, 760 bp, Homo sapiens
  misc_feature: GZ8MTXP01BR95T.3.79.H02.1.454.CMB.2.raw
  modified_base (246)..(246): a, c, t, g, unknown or other
  modified_base (251)..(251): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactgaaaccaacagtgacgttgtatttttanatctntgtctctcgtacaacaacaccagacaaacgaccccaaactcatctatttatctatgtacctacgtcgccgttcgggccccgttcgtacggggtttcctcgtacgttccgttccctttttcgtcggtcctaccctaacgttccgttcgcccgacccgtacccgggtccccttacccgtacgacctacgtccgtccggggcctccgacgggctggaacggacgtacgggtcttacggtccctttaaagttcgtacggtacctacgggtccctttaaactaacgttaaaccgtaaacggtaacggtaacccgtaacccgtaaaccccgttaccgttaccgggtttacggtttacgggtttaacgggtttaacgggggtaaacgggaaccgggtaaaccggttacggtacccggtaaccgggttaaccccggttaccggttaccgggtaacccgtacccggtaacccggtaaccggtccccgttaccccggttcccccggttaaccgtccccg

SEQ ID NO: 397194 - DNA, 672 bp, Homo sapiens
  misc_feature: GZ8MTXP01D2B6S.3.79.H02.1.454.CMB.2.raw
  modified_base (230)..(230): a, c, t, g, unknown or other
  modified_base (248)..(248): a, c, t, g, unknown or other
  modified_base (253)..(253): a, c, t, g, unknown or other
  modified_base (496)..(496): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacngtgacgttgtatttttanatctntgtctctgtacaacacaccagacaaacgccccaaactcaatcatttactgtatgtcactgcctaccggccctcggtacggggttttcctcgtacttccggttcctttttccgtcggtccttaccctaacggttcccgttacgggcccacccgaccgggtccccttaccccgtcggaccctagtcccgtcggggctccgaggcgtgaacggacgtaggcctaggcctttaatcgtgcgatcgtntaactaagaccaaagggcaccaaacctcgttccgtacggttaggttggtttgggtcgggaacggggtaacccttaaaggtccgttaccggttacccggttccgttaaacggggtcccaccggtaacccgaaaccggggtccttaccccgggtccccccttaacggggttaaccccc

SEQ ID NO: 397195 - DNA, 621 bp, Homo sapiens
  misc_feature: GZ8MTXP01BYCFD.3.79.H02.1.454.CMB.2.raw
  modified_base (230)..(230): a, c, t, g, unknown or other
  modified_base (242)..(242): a, c, t, g, unknown or other
  modified_base (307)..(308): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctcgtgtcgtgggtctcctggacagtcgatcaccatctcctgcacgtggaacaanagtgtacgtttntatttttaatcttctcgtctctagtaccaacaacaccaggacaaacgcccaaatcaatcatttannatgtcatcgcgtcgacctcgtaggtttctcatcgtctttctgctacagtctcggcaccgaccggtccctccgtacaccgtactcccggtacgggctaccggaggcgtaggacggaacggtgtacgtacgtaccttataccgtgacctaggtctaactaattaacgaacgaaaggtaccgacctaaaccctgttaccgttacgggttagtttaggttaagggtaacgggaacggtaacgaacgtcgtacgttacccggttcgttacggtccgaccgaaccgacggtcccttccggtaaccccgttgtaaccccg

SEQ ID NO: 397196 - DNA, 649 bp, Homo sapiens
  misc_feature: GZ8MTXP01DX7S0.3.79.H02.1.454.CMB.2.raw
  modified_base (247)..(247): a, c, t, g, unknown or other
  modified_base (299)..(299): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcaggcacagagtcctgggcccagtctgccctgactcagcctgcctccgtgtctgggtctcctggacagtcgatcaccatctcctgcactggaaccaacagtgacgttgtatttttanatctctgtctctgtaccaacaacaccagacaaacgccccaaatcatgattangagtacacaagcgacctgacgggtcctgactcgcttctcctcgcctcaagtctaggacaacgccgtccctcccgtcgaccgtctcgtcggcctcgacgtcctaggaggtagttacggacggtacttaggtaagtttaacttacgtacgtaccgtaacgggtcttacgtaaattcgtaggaccgtaggactaaactacctaaacgttacgtttcggggtttccgggaacgggaacgggttaccctaaacggttcccgtaacggttaccccggttacgtttcggggaacccaaccgggtaaccccgaacgggtcccgtacccggcccccgttccgggttaacccttccccgg

SEQ ID NO: 397197 - DNA, 562 bp, Homo sapiens
  misc_feature: GZ8MTXP01BGOPV.3.79.H02.1.454.CMB.2.raw
  modified_base (304)..(304): a, c, t, g, unknown or other
  modified_base (335)..(335): a, c, t, g, unknown or other
  modified_base (347)..(347): a, c, t, g, unknown or other
  modified_base (459)..(459): a, c, t, g, unknown or other
  modified_base (490)..(490): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacaccaggcaaagcccccaaactcatcatttangatgtcactgctcggccctcgaggggtttcncatcgtctttcnggctccaagtctgggcaccacggccctccctgacctatcgtccggggctccagggctggaggacgagggctggtcttacttactgacacggcttcataataccgaaagggcncaccctatcgttccgtgggttaatttggggngggttaaggggcccaaaggcctggaacccgttcttagggtcacgcccaaggcttccgcccccgttcggtccc

SEQ ID NO: 397198 - DNA, 579 bp, Homo sapiens
  misc_feature: GZ8MTXP01ADOCL.3.79.H02.1.454.CMB.2.raw
  modified_base (249)..(249): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtaccaacaacaccaggacaaacgcccccaaactcatcaatttactgatgtcactcgctcggccctcgtaggggtttctcatcgtcctttctggtctccaagtctcgcaccacggccctccctcgaccactccgtcggggtctccgaggcgtggagggacgaggtctggtacttattacgtgtacacgggtctactataacgtaacgaaggacaccacctactcgttcggtggttaggtttcgggtgggttacgggacgagtcgtcgaccgttcgttaggtccacgccgaacggccttccgtccccgttcggtaaccc

SEQ ID NO: 397199 - DNA, 770 bp, Homo sapiens
  misc_feature: GZ8MTXP01BH3AJ.3.79.H02.1.454.CMB.2.raw
  modified_base (247)..(247): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctggtctcctggacagtcgatcaccatctcctgcactggaaccaacagtgacgttgtatttttanatctctgtctcctggtaccaacaacacccaggacaaacgcccccaaactcatctatttatgatgtcactgctcggccctcgtacggggtttctcattcgtcctttttctggtcctccaagttcctcgggccaacccgacgggtccctcccgttcgacccacttcccggtccgggggtccttcccggaaggggtccgtacggggaacggggaccgggtaacgggtccgttacgggtaccgttttaaacttaaccgtcgggttacccacgggggtacttacccgtaaattaaacgttaaaccgaaacggggtacgtacccgaaacccctaaccgttaccggttccggtttacggggtttaacggtttttaacgggggtaaggggaaacggggttaaaccccgaaacggtcccggtaacgggttaccccgggttaccgttaacggggttaacccgtaaaccgggtaacccccgtaaaacgggggccccttacccgggtccccccccgttttaacggggtaaccccc

SEQ ID NO: 397200 - DNA, 673 bp, Homo sapiens
  misc_feature: GZ8MTXP01EE1UC.3.79.H02.1.454.CMB.2.raw
  modified_base (247)..(247): a, c, t, g, unknown or other
  modified_base (299)..(299): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctctgcactggaaccaacagtgtacgttgtatttttanatctctgtctctgtacaacaacaccagacaaacgccccaaatcatcatttangatgtcactcgctccggtcctcgtagggtttcctcgacttccgttccttttcgcggtctaccgtagtccgtcggccacccgacccggtccctccccgtagacccgtagttccgtccggggcttaccgaggcgtaggacggtacggagtcgtacgtacttactacgtcgactagggtactacgtaacgtaagtaaccggaaacggacctaaccgtaaccgtaccgttcggttaccggtttagggttaggttttaacggggacgggaacgggtaaacccgttaggtaccgttacggacccggttcgttaaccgggtaaccgaaccgtaaccccggtaacggtcccgttaccccgtcccccggttcggttaaccccg

SEQ ID NO: 397201 - DNA, 600 bp, Homo sapiens
  misc_feature: GZ8MTXP01EQPOJ.3.79.H02.1.454.CMB.2.raw
  modified_base (248)..(248): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaccaacagtgacgttgtattttttanatctctgtctctgtaccaacacacccagacaaacgccccaaatcatgaatttatgaggtacaacaaagccgccctcgacgggtccctgactcgcttctcctcgcctacaagtctacggacaaccgacggccctcccgcgtaccgtctcgtcgggctccagccgtgaggatggaggtctagtattactacgtgtcgaaggtctactatagtcggacaggtacctaatacctaaacgtacgttccggtttacggggaaccgggtaaggaaccgtaaacggttcgtacggtacccgttccgttacggccgaacggcccgaacggtcccgtaccgccccgtccgggttctaacccg

SEQ ID NO: 397202 - DNA, 659 bp, Homo sapiens
  misc_feature: GZ8MTXP01BPS1X.3.79.H02.1.454.CMB.2.raw
  modified_base (250)..(250): a, c, t, g, unknown or other
  modified_base (255)..(255): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgacgcagcctgcctccgtgtctgggtctcctggacagtcgatcaccatctcctgcactggaaaccaacagtgtacgttgtatttttanatctntgtctctgtaccaacaacaccagacaacgaccccaaactcatcatttatgatgtcactcgtcctccggtccctcgtacgggtttcctctacttccgttccttttcgtacggtcccttaccgtaagttcccgtacggcccaacccgtacccgggtccccttccccgtacgtaccctacgttcccggtcccggggtcctacccggtagggtcgttacgggacgggaccggtacgggtccttacggttaccttacgttaacgtgaccgtacggtacctacgtaatacgtaacgacggtacgacctacctacgtcgttcggttggttagttgggtaggacggaccttaagccgtcgaccgttccgttagtccacgaacccgacgtccgttccgtccccgttcgtcccg

SEQ ID NO: 397203 - DNA, 826 bp, Homo sapiens
  misc_feature: GZ8MTXP01C821Z.3.79.H02.1.454.CMB.2.raw
  modified_base (257)..(257): a, c, t, g, unknown or other
  modified_base (302)..(302): a, c, t, g, unknown or other
tcagagacgcactccacgaccggtgctcgatttagtgtcacacgaagggaaagggggggggtctcaggaggcagcgctctcgggacgtctccaccatggcctgggctctgctattcctcaccctcctcactcagggcacagagtcctgggcccagtctgccctgactcagcctgcctccgtgtctgggtctccgtggacagtcgatcaccatctcctgcactacggaaaccaacgagtgtacgtttgttatttttanattctctgtctctgtaccaacaacaccagacaaacgccccaaacncatactatttactgtatcgtctactcgccgtccggtccctcgtacggggtttcctactagttccgtttccttttcgtcggtcctaccgtaacgttccgtcggtccacccgacccgggtcccctccccgtacgtacctacgtcccggtccggggtcctacccggagggtacgtagggacggggaacggtaacgggtccgtttacgggtactttaaccgttacgtacgtaccgtaacggggttacccttaacggtaaacttaaacgttaaaccggtaaacggggaaccgtacccttaaacccgttaccgtttacccggtttaccgggtttagggttttaaacgggtttttcgggggaacgggggttaaacccgggggaaacccggttaaacgggttacccggttaacccggggttaaaccccggttcccggtttaaccgggaacccggtaaacccggtaaccccggtaaaacccggggtccccgttaacccccggggtccccccgttaaccggggtttaacccccg

SEQ ID NO: 397204 - DNA, 535 bp, Homo sapiens
  misc_feature: GZ8MTXP01ATBFW.3.79.H02.1.454.CMB.2.raw
  modified_base (247)..(247): a, c, t, g, unknown or other
  modified_base (340)..(340): a, c, t, g, unknown or other
  modified_base (355)..(355): a, c, t, g, unknown or other
  modified_base (509)..(509): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctcctggtaccaacaacacccaggacaaacgcccccaaactcatcatttatgatgtcactgactccggccctcgtaggggtttcnctatcgtccttttcnggtctccaagtctggccaccaccggcctccctgaccatccgtcgggctccgaggctgaggacgagtctgcttatactgcacggctcatacgtaacaaggacacaccactcgtacgtggtacttggtggaggacagctgaccgttcgttaggtcncgccgacgcttcgtccccgttgtccc

SEQ ID NO: 397205 - DNA, 564 bp, Homo sapiens
  misc_feature: GZ8MTXP01BZ3V5.3.79.H02.1.454.CMB.2.raw
  modified_base (231)..(231): a, c, t, g, unknown or other
  modified_base (249)..(249): a, c, t, g, unknown or other
  modified_base (377)..(377): a, c, t, g, unknown or other
  modified_base (443)..(443): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaangtgacgttgtatttttantctctgtctctgtaccaacaacaccagacaaacgccccaaactcatcattatgatgtcactgctccgcctcgtagggtttctcatcgtcctttctgctccaagtctcgccaccaccggtccctccccngaccatcccgtcggggctccgaggctggacggacgagctgtcttatactgcacggcttacaattanaacgaaggctacaacccgtactcgtcgtggtttaattgggtggaacgggacaaagggtctcggaccgttccgacggttaacaccgcccgaaggccttcccggtcccccgttaacgggtccc

SEQ ID NO: 397206 - DNA, 707 bp, Homo sapiens
  misc_feature: GZ8MTXP01CY2PC.3.79.H02.1.454.CMB.2.raw
  modified_base (255)..(255): a, c, t, g, unknown or other
  modified_base (338)..(338): a, c, t, g, unknown or other
  modified_base (367)..(367): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactcggaaaccaacagtgtacgtttagtattttttanattccttctgtcctcctacggtaaccaaaccaacacccgaaggcaaaaccgcccccaaactccatctaatttatgaatgtacnctgctccggtccctcgtagggtttctacnttccgttccttttcgtggtcctaccgtaacgtccgtacgcccaccccgtacccgggtcccttaccccgtacgacccctagtcccggtccggggccgtccgacggtcgtcggaacgggacgacggtctgtacttaagttacgtgtcgtacggtctacctaaattaacgtaacgaaacggacgaccaacccgtacttccgttcggttacgggtttagggtttcggggtaacggggacgggtaaccgttaaacggtccggttacggttacccggttccgttaccgggtcgaaaccgggcccgttaacgggccccttacccggtcccccgttcgggtaaccccg

SEQ ID NO: 397207 - DNA, 671 bp, Homo sapiens
  misc_feature: GZ8MTXP01BCCO7.3.79.H02.1.454.CMB.2.raw
  modified_base (248)..(248): a, c, t, g, unknown or other
  modified_base (302)..(303): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctggtaccaacaacaccaggacaaacgccccaaatcatcattannatgtcactcgctccggccctcgtagggtttctcacttcgtccttttctggtctccgaagtctcggcctacccgacccgggtccctaccccgttacgaccctagtcccgtccgggggccttcccggaagggtcgttagggacggacggacgggtcttacggtacttacttaaccgtgaccgtagggtaccttacgtaactaacgtaacgaacgggacgacctaaaccctcgttacccgttcgggttacggttaagttggggtaacggggttaacgggtaacccgaaaggtccgtacggttacccggttccggttacggtcgtaaccggcccgttaaaggcccgttaccggtcccccgttcgggttcccc

SEQ ID NO: 397208 - DNA, 564 bp, Homo sapiens
  misc_feature: GZ8MTXP01APS39.3.79.H02.1.454.CMB.2.raw
  modified_base (243)..(243): a, c, t, g, unknown or other
  modified_base (303)..(303): a, c, t, g, unknown or other
  modified_base (416)..(416): a, c, t, g, unknown or other
  modified_base (446)..(446): a, c, t, g, unknown or other
  modified_base (464)..(464): a, c, t, g, unknown or other
  modified_base (516)..(516): a, c, t, g, unknown or other
  modified_base (543)..(543): a, c, t, g, unknown or other
  modified_base (556)..(556): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacattggtnattataactatgtctcctggtacagcagcaccgagacaaacgccccaatcatgaatttangacgtacacaaacggccgccgtacgacgggtcctgactcccgtcttctctcgcctaccaagtcgtggacaacgaccgtcctcccgtcgaccttctcgtgggcctcgaggtccnggacggacgacgtctacgtacttattaccnggggacctaagtccttanaacttaacgaaccaagggacctacgaccttactcgttcgtggtagtttcggnggacggacagcgttcgaccgtcgtgcncgtaccgagtccnccgtcccg

SEQ ID NO: 397209 - DNA, 685 bp, Homo sapiens
  misc_feature: GZ8MTXP01B72F2.3.79.H02.1.454.CMB.2.raw
  modified_base (255)..(255): a, c, t, g, unknown or other
  modified_base (283)..(283): a, c, t, g, unknown or other
  modified_base (301)..(301): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactaggaaaccaactagtgtacgttgtattttatatctntgtctctgtacaacaacaccagacaacncccaactcatacattatntatgtcactgcctccgtccgtcgtagggtttcctctacgtcgttccctttcgtggtcctacctagtcctacggcccgaccgacccggtcccctcccgtacgaccctacgtcccggtccggggtccttccggacgggcggtcggaacgggacggtacggtcgttcgtactttacgttacgtgtaccgtagggccttactaaactaagtaaccgaaggtaccgacctacctaccgtcgttcgggttaggttcggtttaaggggtacgggaaacggggtaaccgttaaggttacccggttaccgggttacccggtttccggaaccggttccggaaccgtaaccccggtaacggtccccgttcccggtcccccggttaacgttccccg

SEQ ID NO: 397210 - DNA, 753 bp, Homo sapiens
  misc_feature: GZ8MTXP01A3UFQ.3.79.H02.1.454.CMB.2.raw
  modified_base (230)..(230): a, c, t, g, unknown or other
  modified_base (249)..(249): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctccgtggacagtcgatcaccatctcctgcactggaaccaanagtgacgttgtatttttanattctctgtctctgtaccaacacaccaggacaaacgccccaaactcatctatttatgtatcgtcactcgccgtccggtccctcggtacggggttttactcgtacgttccgttcccttttcgtcggtcctaccgtaacgttcgtcgggccgaccccgaccgggtccctccccgtacgtacccgagttcccggtccggggtcctcccggaacgggtcgtagggaacgggaccggtacgggtcgttacggtactttaacgtaaccgttgtaccgacggggtaccttaaccgtaagttaaacgtaaacggtaaaggggtaaccgccctaaacccgtaaccgtttaccgggttccgggtttacggggtttaaggttttcgggggttaacggggaaacggggtaacccggttacggtaccgtaccgggttaccccggttcgttaccgggtaaccgaaccggtaaccccggtaacggtcccgttacccggtccccgttaaccgggttcccg

SEQ ID NO: 397211 - DNA, 672 bp, Homo sapiens
  misc_feature: GZ8MTXP01C3KWD.3.79.H02.1.454.CMB.2.raw
  modified_base (229)..(229): a, c, t, g, unknown or other
  modified_base (246)..(246): a, c, t, g, unknown or other
  modified_base (251)..(251): a, c, t, g, unknown or other
  modified_base (288)..(288): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaccaacngtgacgttgtattttanatctntgtctctgtacacaacaccagacaaacgccccaaacncatcatttatgatcgtacactcgcctaccgggtccctacggtagggtttctctattccgtccttttctcggtcctacctaagttcctcggcccaccgaacccgggtcccttccctacgaccctagtcccgtccggggcttccgaggcgtagaggacgacgtctacgtcgttaacttcgtagctacgggtctactaaagtactaaacgaagggacgactaaacccgtctacgttaccggttggttaaggtttcgggaacggggttaacgggtacccgttaacggtaaccggttccggttaaccccgttccggttacggtccggtaacccgccccggtaaacgggtccccgttcccgggtaaccccccgttccgggtttaaccccg

SEQ ID NO: 397212 - DNA, 837 bp, Homo sapiens
  misc_feature: GZ8MTXP01ARK7H.3.79.H02.1.454.CMB.2.raw
  modified_base (311)..(311): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctcgtgtcgtgggtctccgtggacagtcgatcacatctctgcacgtagaaaccagagtgtacgtttgtatttttaattcttctgtctcgtagtaaccaacaaccaccagaccaaccgaccccaaatcatctatttangtatgtacactcgtctccggtccgttcggtacggtttctcgtacgttccgttcccttttccgtacggtccgttaccctaacggttccgttaccgggccctaccccgtaccccgggtccccttacccccggtaccgaaccccgttacgttccccggggtacccggggtccgttacccccgggagggttaccccggtaggggtaacgggaaccgggtaccgggtaccgtttacgggttaacctttaacgttaaccggtcgtacccgttaacggggtacttaccgttaaagttaaccgtaacggtaaaccgtaccgaaccccgttaaacccgtccgtttaccgggttaaccggtttaggttaacgggttttaacgggggacgggttaaacccgggggtaaccttaaacggggttcccgttaaccgggttaccccgggtttcgttaacccgggttaacccgacccgggtaaaccccggtaccgggttccccgttcccccgggttaacccccgttaacggggtttcccccg

SEQ ID NO: 397213 - DNA, 505 bp, Homo sapiens
  misc_feature: GZ8MTXP02GV8HJ.3.79.H02.1.454.CMB.2.raw
  modified_base (243)..(243): a, c, t, g, unknown or other
  modified_base (341)..(341): a, c, t, g, unknown or other
  modified_base (430)..(430): a, c, t, g, unknown or other
tcagagacgcactccacgaccggtgctcgatttagtgtcacacgaagggaaaggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctggtaccaacaacaccaggcaaagcccccaaactcatcatttatgatgtcactgctcggcctcaggggtttctcatcgccttttcngctccaagtctggcaccacggcctccctgaccatctcggggctcccagctgagacgaggctgcttatactgcagctcatatacaaggancacactctacgtgtatttggtggagggaccaagctcgaccgtcctaggtcacgcccaaggctcgccccctggtcc

SEQ ID NO: 397214 - DNA, 501 bp, Homo sapiens
  misc_feature: GZ8MTXP02HSSGS.3.79.H02.1.454.CMB.2.raw
  modified_base (244)..(244): a, c, t, g, unknown or other
  modified_base (421)..(421): a, c, t, g, unknown or other
  modified_base (424)..(424): a, c, t, g, unknown or other
  modified_base (449)..(449): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctggtaccaacaacacccaggcaaagcccccaaactcatcatttatgatgtcactgctcggccctcaggggtttctcatcgcttttctggctccaagtctggcaccacggccctccctgacccatctcggggctccaggctgagcgagctgcttatactgcagctnatnacagagcacactctcgtgtattggngtagggaccaagctgaccgtctaggtcagcccaaggcctcgccccctggtcc

SEQ ID NO: 397215 - DNA, 500 bp, Homo sapiens
  misc_feature: GZ8MTXP02FZ6EN.3.79.H02.1.454.CMB.2.raw
  modified_base (244)..(244): a, c, t, g, unknown or other
  modified_base (326)..(326): a, c, t, g, unknown or other
  modified_base (338)..(338): a, c, t, g, unknown or other
  modified_base (413)..(413): a, c, t, g, unknown or other
  modified_base (425)..(425): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccacaacaccagcaaagccccaaactcatcatttatgatgtcactgctcggccctcgaggggtttcncatcgcttttcngctccaagtctggcaccacggcctccctgaccatctcgggctccagctgagacgaggctgcttatactgcagctnatatacaaggancaccactctcgtgtatttggtggaggaccaagctcgaccgtccgtaggtcacgccaacggctcgccccctggtcc

SEQ ID NO: 397216 - DNA, 518 bp, Homo sapiens
  misc_feature: GZ8MTXP02JUFQI.3.79.H02.1.454.CMB.2.raw
  modified_base (245)..(245): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccacacaccagcaaagccccaaactcatcatttatgatgtcactgctcggccctcaggggtttctcatcgccttttctgctcagtctggcaccacggccctccctgaccatctcggggctccgaggctggagacgaggctgcttatactgcagctcatataacaagacgacaccgactctcgtgttagtttcggtggagggtaccaaaggctcgaccgtctaggtcacggacccgacggcctcgcccccgtcggtacc

SEQ ID NO: 397217 - DNA, 565 bp, Homo sapiens
  misc_feature: GZ8MTXP02HUQDV.3.79.H02.1.454.CMB.2.raw
  modified_base (245)..(245): a, c, t, g, unknown or other
  modified_base (337)..(337): a, c, t, g, unknown or other
  modified_base (421)..(421): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaccaacagtgacgttgatttttanatctctgtctctgtaccaacaacaccagcaaacgccccaaatcatcatttatgatgtcatgctcggcctcagggtttctcatcgtcttttcnggtctaccagtctggccaccacggcctccctgacccatccgcggggctccgaggctggagacgaggctgcttatactgcagctnaatataacgaaggacacaaccacttcgtcgttagttagttttggagggtaacgggaccgaaagtccgttacgaaccccgttccgtaacgggtccgaacggaccccgtaaacggggcccttccggaccccccgtttcgggtcccc

SEQ ID NO: 397218 - DNA, 507 bp, Homo sapiens
  misc_feature: GZ8MTXP02HJ9XN.3.79.H02.1.454.CMB.2.raw
  modified_base (226)..(226): a, c, t, g, unknown or other
  modified_base (244)..(244): a, c, t, g, unknown or other
  modified_base (337)..(337): a, c, t, g, unknown or other
  modified_base (413)..(413): a, c, t, g, unknown or other
  modified_base (425)..(425): a, c, t, g, unknown or other
  modified_base (454)..(454): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaanagtgacgttgatttttanatctctgtctctgtaccaacacaccagcaaagccccaaatcatcatttatgatgtcactgctcggccctgagggtttctcatcgtccttttcngtctccaagtctggccaccacggccctccctgacccatcctcggggctcccgagctgaggacgagctgcttatacngcagctcattanacgaagacgcacactctcgtgttattggnggaggaccaagctacgaccgtctaggtcagccaaggcctcgccccgtacgtcc

SEQ ID NO: 397219 - DNA, 512 bp, Homo sapiens
  misc_feature: GZ8MTXP02IZBD4.3.79.H02.1.454.CMB.2.raw
  modified_base (245)..(245): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctggtaccaacaacaccagcaaacgcccccaaactcatcatttatgatgtcactgctcggccctcgaggggtttctcatcgtccttttctggtctccaagtctgcaccacggcctccctgaccatctcggggctccaggctgaggacgaggctgcttatactgcagctcatatacaaggagcacactctacgtgtagttggtggagggaccaagctcgaccgtctaggtcgcgaccaacggctacgcccctcggtcc

SEQ ID NO: 397220 - DNA, 522 bp, Homo sapiens
  misc_feature: GZ8MTXP02H34S0.3.79.H02.1.454.CMB.2.raw
  modified_base (245)..(245): a, c, t, g, unknown or other
  modified_base (338)..(338): a, c, t, g, unknown or other
  modified_base (365)..(365): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttanatctctgtctcctgtacaacaacaccagcaagccccaaatcatcatttatgatgtcactgctcgccctcaggggtttctcatcgtccttttcnggctcaagtctgcaccacggccctccngaccatccgtcggggctccgaggctgaggacgaggctgcttatactgacagctcatatacaaggacgcaccactcgtcgtgttaatttgggaggtagggaccaaaggctacgaccgtcgtacgtcgacgacccgaggcctccgccccgttacggccc

SEQ ID NO: 397221 - DNA, 551 bp, Homo sapiens
  misc_feature: GZ8MTXP02G9TVU.3.79.H02.1.454.CMB.2.raw
  modified_base (246)..(246): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctggtaccaacaacacccaggcaaacgcccccaaactcatcatttatgatgtcactgctcggccctcaggggtttctcattcgtccttttctggtctccaagtctggccaccacggccctccctcgacccactccgtcggggcctccgagctggagacgaggctgcttattactgcagctacatactaacaaggagccaaccactcgtacgttgttatttcgggtgggacggaccaggctcgtaaccgtccgtaggtccgacgtacccgacggctccggcccccttacggtccc

SEQ ID NO: 397222 - DNA, 524 bp, Homo sapiens
  misc_feature: GZ8MTXP02GVY4V.3.79.H02.1.454.CMB.2.raw
  modified_base (245)..(245): a, c, t, g, unknown or other
  modified_base (345)..(345): a, c, t, g, unknown or other
  modified_base (438)..(438): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctggtaccaacaacacccaggcaaagcccccaaactcatcatttatgatgtcactgctcggccctcaggggtttctcatcgccttttcngtctcaagtctggcaccacggcctccctgaccatccgtcggggctccgaggctgaggacgaggctgcttattactgcagctcatatacaaggngcacactctcgtggtactttggtaggagaaccaagctacgacccgtctaggtcacgacccgaaggcctccgcccccgtcggtaccc

SEQ ID NO: 397223 - DNA, 733 bp, Homo sapiens
  misc_feature: GZ8MTXP02H0RWM.3.79.H02.1.454.CMB.2.raw
  modified_base (247)..(247): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgattttttanatctctgtctctgtacaacaacaccagacaaacgccccaaactcatcatttatgatgtcactgctcggccctcgtaggggtttctctatcgtctttctggtctactaagttctggccacccgtacggccccttcccgtacgaccctacttccggtccggggcctcccggacgggtcctacgggacgggaccggtacgggccgtttacggtacctttacgtttaaccgtcgtaccgaacggtcctttaacctaattaaacgttaaaccgaaaagggtaaccgaacccgtaaacccctaaacgtttacccgttcgggtttacgggtttaaaggttttcgggggtaacgggggtaaccggggtaaacccgtaaaacgggtcccggttacggtaacccccgggtttacccgttaaaccggggttcccgaaacggtaccccggaaaacgggtcccgtccccgggtacccccccgtttccggggttaccccg

SEQ ID NO: 397224 - DNA, 498 bp, Homo sapiens
  misc_feature: GZ8MTXP02FXG90.3.79.H02.1.454.CMB.2.raw
  modified_base (300)..(300): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcagtcaccatctcctgcactggaaccagcagtgacattggtgattataactatgtctcctggtaccagcagcaccaggcaaagcccccaaatcatgatttangaggtcacaaagcggccctcgagggtccctgactcgcttctctgcctcagtctgcaacacgcctcctgaccgtctctgggctcagcctgagatgagctagattattacgtgcagtctcatatgcaggcagtcaaactcttggtttcggacggtacgggacaacgctagaaccgtctaggtcacgccaacggctcccgg

SEQ ID NO: 397225 - DNA, 568 bp, Homo sapiens
  misc_feature: GZ8MTXP02GKRIE.3.79.H02.1.454.CMB.2.raw
  modified_base (247)..(247): a, c, t, g, unknown or other
  modified_base (252)..(252): a, c, t, g, unknown or other
  modified_base (336)..(336): a, c, t, g, unknown or other
  modified_base (351)..(351): a, c, t, g, unknown or other
  modified_base (451)..(451): a, c, t, g, unknown or other
tcagagacgcactccacgaccggtgctcgatttagtgtcacacgaagggaaagggggggtcgtcaggaggcagcgctctcgggacgtctccaccatggcctgggctctgctattcctcaccctcctcactcaggcacagagtcctgggcccagtctgccctgactcagcctgcctccgtgtctgggtctcctggacagtcgatcaccatctcctgcactggaaccaacagtgacgttgtatttttanatctntgtctcctggtaccaacaacaccaggacaaacgcccccaaatcatctatttatgatgtcactgctcggccctcgtagggtttcncatcgtccttttcgngtctcaagtctggccaccacggccctccctgacctctcgtcggggctccgaggctggaggacgaggctgtacttatactgcaggctcatactacgaaagngaccaacctacgttcgtcggtaggttaacgtttggggacggtaacgggaaccaaggtctacggaacccgtcgttacgggaacacgaccgaacggcctccgggtccccctcgggtccc

SEQ ID NO: 397226 - DNA, 500 bp, Homo sapiens
  misc_feature: GZ8MTXP02IJXFP.3.79.H02.1.454.CMB.2.raw
  modified_base (244)..(244): a, c, t, g, unknown or other
  modified_base (325)..(325): a, c, t, g, unknown or other
  modified_base (339)..(339): a, c, t, g, unknown or other
  modified_base (366)..(366): a, c, t, g, unknown or other
  modified_base (374)..(374): a, c, t, g, unknown or other
  modified_base (430)..(430): a, c, t, g, unknown or other
  modified_base (434)..(434): a, c, t, g, unknown or other
  modified_base (437)..(437): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtacaacaacaccagcaaagccccaaactcatcatttatgatgtcactgctcggccctcaggggtttcncatcgtccttttcngctccaagtctgcaccacggcctcccngaccatcncgggctccgaggctgaggacgaggctgcttatactgcagctacatatacaaggacncacnctntcgtgtatttggaggaggacaagctacgaccgtctaggtcagcccaaggctcgcccctggtcc

SEQ ID NO: 397227 - DNA, 513 bp, Homo sapiens
  misc_feature: GZ8MTXP02JXQ6G.3.79.H02.1.454.CMB.2.raw
  modified_base (245)..(245): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttanatctctgtctcctggtaccaacaacacccaggcaaagcccccaaactcatcatttatgatgtcactgctcggccctcaggggtttctcatcgccttttctggctccagtctggcaccacggccctcctgaccatctcggggctccaggcctggaggacgaggctgcttattactgcagctcatatacaagagcaccactctcgtgtatttggtggaggaccaagctgaccgtcctaggtccagcccaaggcctcggccccctcggtcc

SEQ ID NO: 397228 - DNA, 520 bp, Homo sapiens
  misc_feature: GZ8MTXP02G3CVR.3.79.H02.1.454.CMB.2.raw
  modified_base (333)..(333): a, c, t, g, unknown or other
  modified_base (346)..(346): a, c, t, g, unknown or other
  modified_base (463)..(463): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctggtaccaacaacacccaggcaaacgcccccaaactcatcatttatgatgtcactgctcggccctcgagggtttcncatcgccttttcnggctccaagtctcggccaccgacggtcctccctgaccatcgtcggggctccgagctgaggacgaggctgcttatactgcagctcatatacaagacgcaccactctcgtgtacttggnggaggtaccagctacgaccgtccgtaggtcacgcccgaggctcgcccccgtggtccc

SEQ ID NO: 397229 - DNA, 508 bp, Homo sapiens
  misc_feature: GZ8MTXP02F72T1.3.79.H02.1.454.CMB.2.raw
  modified_base (335)..(335): a, c, t, g, unknown or other
  modified_base (348)..(348): a, c, t, g, unknown or other
  modified_base (428)..(428): a, c, t, g, unknown or other
  modified_base (439)..(439): a, c, t, g, unknown or other
  modified_base (458)..(458): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctcctggtaccaacaacaccaggcaaacgcccccaaactcatcatttatgatgtcactgctcggccctcgtaggggtttcnatcgtccttttcnggtctccaagtctggccaccacggcctccctgaccatctcggggctccgagctgagacgaggctgcttatactgcagctnatatacaagancacactctcgtgtattggnggtaggaccaagctacgaccgtcgtagtcacgccacgctcgcccctgtcc

SEQ ID NO: 397230 - DNA, 628 bp, Homo sapiens
  misc_feature: GZ8MTXP02FNMX8.3.79.H02.1.454.CMB.2.raw
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccagcagtgacattggtgattataactatgtctcctggtaccagcagcacccaggcaaacgcccccaaactcatgatttatgaggtacaacaaacgccggccctcgacggggtccctgactcgcttctctcgccctacagtctcgaccaacgaccggtcctcccgtcgtacccgttctcgttcgggcctccgacgtcctaggacggtagtgggacggtcgttagtaactttaagttacgtggacctacggttcctactaagttactcggacacggactacgtacccaaaacttcggtttacggtttaccggggaccgggaaacggggtaacctaaacggtccgttaccggaacccgttacccggtaacggtcccaaccggacccgtaacggtcccttacccccgg

SEQ ID NO: 397231 - DNA, 562 bp, Homo sapiens
  misc_feature: GZ8MTXP02ISZGG.3.79.H02.1.454.CMB.2.raw
  modified_base (245)..(245): a, c, t, g, unknown or other
  modified_base (344)..(344): a, c, t, g, unknown or other
  modified_base (488)..(488): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacaacaccagcaaacgcccccaaatcatcatttatgatgtcactgctccggccctcgaggggtttctcatcgtctttttcnggtctccaagtctcggccaccgaccggtccctccctcgacctagtccgtcgggggctccgaggctggacggacgaggctgtcttatacgtgactagctcatataacgaaggtcgaccaccacttcgtcgtggttacgtttgggnggtacgggacctaaggcgtacgtaccgtcgtacggtcgacgcccgaacggtccgtccgtcccccgtcggtaccc

SEQ ID NO: 397232 - DNA, 585 bp, Homo sapiens
  misc_feature: GZ8MTXP02HGZO0.3.79.H02.1.454.CMB.2.raw
  modified_base (228)..(228): a, c, t, g, unknown or other
  modified_base (301)..(301): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacngtgacattggtgattataactatgtctcctggtaccagcagcacccaggcaaagcccccaaatcatgatttangaggtcacaaagcggcctcgaggggtccctgatcccgcttctctgcctcaagtctggacaacgacgcctcccgtgacccgtctctcgggcctccgagcccgtggacggatggaagggtctaggtaatttagtttacctggactaggccttacattagtcgacgacggactaactacaaactacgtttcggttttccgggacgggtaacggggaaccaaacggtccgtacggtaacccgtccgttaacggtaccgacgaccccgaacggccgtccggtccccccg

SEQ ID NO: 397233 - DNA, 524 bp, Homo sapiens
  misc_feature: GZ8MTXP02IGZG8.3.79.H02.1.454.CMB.2.raw
  modified_base (247)..(247): a, c, t, g, unknown or other
  modified_base (441)..(441): a, c, t, g, unknown or other
  modified_base (487)..(487): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttanatctctgtctctggtacaacaacaccaggcaaagcccccaaactcatcatttatgatgtcactgctcggccctcaggggtttctcatcgtccttttctgtctccaagtctgggcaccacggccctccctcgaccatcgtcggggctcccaggctgaggacgaggctgcttatctagcagctcatatacaaggancactactctacgtggtatttggtggacgggacaagctagacccgtntacggtcacgacccgagccgtcgtcccccgtggtacc

SEQ ID NO: 397234 - DNA, 576 bp, Homo sapiens
  misc_feature: GZ8MTXP02IG45O.3.79.H02.1.454.CMB.2.raw
  modified_base (346)..(346): a, c, t, g, unknown or other
  modified_base (444)..(444): a, c, t, g, unknown or other
  modified_base (446)..(446): a, c, t, g, unknown or other
  modified_base (452)..(452): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttaattctctgtctctggtacaacaacaccaggcaaacgacccccaaactcatcatttatgatgtcatgctcggccctcgagggtttctctatcgtccttttcncgtctcaagttcgtcgcacccacggccctaccctcgaccactccgtccggggtctccgaggcctggagacgaggctgcttatactgcagctacattananaaggancaccacttctcgttagttatttcgggtaggacgggtaaccgaaagtcgtacgacccggtttacctaggtaaccgaccggaaccccgacgggtaccttcccggacccccgttacgggttaccccg

SEQ ID NO: 397235 - DNA, 519 bp, Homo sapiens
  misc_feature: GZ8MTXP02II19F.3.79.H02.1.454.CMB.2.raw
  modified_base (247)..(247): a, c, t, g, unknown or other
  modified_base (328)..(328): a, c, t, g, unknown or other
  modified_base (340)..(340): a, c, t, g, unknown or other
  modified_base (456)..(456): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgccactggaaccaacagtgacgttgattttttanatctctgtctctggtaccaacaacaccagcaaagcccccaaactcatcatttatgatgtcactgctcgcctcagggtttcncatcgtctttcngctcagtctggcaccacgccctccctcgcatccgcggggctccgaggctgaggacgagctgcttagtactgcagtctacatataaccaaggcacactactctcgtgttagtttggnggtacggaccaaagctcgacccgttctaggtcgacgacccaaggcctcgacccccgtggtacc

SEQ ID NO: 397236 - DNA, 516 bp, Homo sapiens
  misc_feature: GZ8MTXP02JA5B2.3.79.H02.1.454.CMB.2.raw
  modified_base (244)..(244): a, c, t, g, unknown or other
  modified_base (274)..(274): a, c, t, g, unknown or other
  modified_base (324)..(324): a, c, t, g, unknown or other
  modified_base (337)..(337): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtacacacaccagcaaanccccaaactcatcatttatgatgtcactgctcggccctcgaggggtttcncatcgccttttcngctccagtctggcaccacggccctccctgaccactccgtcggggcctcccgaggctggaggacgaggctgcttagttactgtccagtctacatatacaaggcgcaccactctcgtggtatttggtggaggacagctacgaccgtctacggtcacgaccacggctacgccccgtcggtcc

SEQ ID NO: 397237 - DNA, 748 bp, Homo sapiens
  misc_feature: GZ8MTXP02I2PRH.3.79.H02.1.454.CMB.2.raw
  modified_base (349)..(349): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctcctgtaccaacaacaccagcaaacgccccaaactcatcatttatgatgtcactgctccggccctcgtacgggtttctctatcgtccttttcncggtctcctaagtctcggcctacccgaccggtcccctcccgtcgaccctacgtcccgtccgggggcccttcccggaacgggtccgttacgggaacggggaaccggtaacgggtccgttacggttacctttaactttaaccgtcgtaccgtaacggtccttacctaaatttaacgtaaaacgaaacggtacgaaccctaacccgtaccttaccgttccgggtttagggtttaaccggttttaggggttaacgggggaaccggggtaaacccgtaaaacggtccggttaccggaaaccccggtttaccccggttaaaacggggttcccgtaaccgggaacccccgttaaacggggaccccgttacccccggttacccccccgttccggggtttaacccccg

SEQ ID NO: 397238 - DNA, 673 bp, Homo sapiens
  misc_feature: GZ8MTXP02GQNQL.3.79.H02.1.454.CMB.2.raw
  modified_base (333)..(333): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctgtaccaacaacaccagacaaacgccccaaatcatcatttatgatgtcactgctccggcctcgtaggggtttcnctatcgtcctttttcgcggtcctaccgtaacgtccgtacgggcctaacccgaccgggtcccttaccccgtcgtaaccccacgttcccgggtccgggggtcccttcccgagggtccgtagggacggggtacggacgggtctcggtactttacgttacgtgccagtcctacaatacgtaacgaacggaacgacaaccctacgttcgtacggttaggttacgtttacggggtagggaacgggtaaccgtaaacggtccgtaccggtaaaccggttccggtaacggtaaccgacccggtacccggaaacgggtccctacccggtccccccgttcgggttacccg

SEQ ID NO: 397239 - DNA, 619 bp, Homo sapiens
  misc_feature: GZ8MTXP02JNVSV.3.79.H02.1.454.CMB.2.raw
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctctgtctctgtaccaacacaccaggacaacgccccaaactcactcatttatgatgtcactgctccggccctcgtacgggtttctctatcgtcccttttcgtcggtcctaccgtaagtcgttcggccacccgtaccggtccccttccctagaccctacgtccggtccggggcctcccggaggcgtaggacggacgagggctgtcttattacgtgctagtctacaatacgtaacgaaggacacctacctacttccgtacggttagggttagtttacggggtagggacgggtaacctaggtaccgtacgacccgttaccgtacggtccgaacggtacccgacggtcccgtcccgtcccccgttcggtaccc

SEQ ID NO: 397240 - DNA, 571 bp, Homo sapiens
  misc_feature: GZ8MTXP02HV48G.3.79.H02.1.454.CMB.2.raw
  modified_base (246)..(246): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacacaccagcaaacgccccaaatcatcatttatgatgtcactgcctcggccctgagggtttctcatcgtccttttctgctacctaagtcctgggccaccgacggtccctcccctgacccattccgtcggggctccgaggctaggacggtacgaggctgactttatactagcaagtcttacatatacgaaggacacaacgactcgtacgtgtagtttgggaggtacggaccaaagggtcctacggacccgttcgtaacgggtccacggaccccgtaaagggccctaccggcccccgttcggtaccccg

SEQ ID NO: 397241 - DNA, 526 bp, Homo sapiens
  misc_feature: GZ8MTXP02JJ4I2.3.79.H02.1.454.CMB.2.raw
  modified_base (245)..(245): a, c, t, g, unknown or other
  modified_base (330)..(330): a, c, t, g, unknown or other
  modified_base (343)..(343): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctctgtctctggtaccaacaacaccaggcaaagcccccaaactcatcatttatgatgtcactgctcggccctcgagggtttcncatcgccttttcngctccagtctggcaccacgcctccctgaccatctcgggctccgagctgaggacagggctgcttattacgtgcagctcagtatacaagacgcaccactccgtacgttggtattttgggaggaggggtacccaaggcgtcgaaccgtcctagggtccagcccgaaggcctcgccccctggtaccc

SEQ ID NO: 397242 - DNA, 559 bp, Homo sapiens
  misc_feature: GZ8MTXP02GOU2X.3.79.H02.1.454.CMB.2.raw
  modified_base (245)..(245): a, c, t, g, unknown or other
  modified_base (471)..(471): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccacaacaccaggcaaagcccccaaactcatcatttatgatgtcactgctcggccctcgaggggtttctcatcgtccttttctggctccaagtctgggcaccacggccctccctgaccatcctcggggctcccgaggctggagacgaggctgcttatctgcagctcatactacgaaggcacaccactcgtccgttggtaacgtttcggggngggacggggtaccaaagccgtacggacccgttccgtagggtaaccacgaccccgtaaacggcccgtaccgccccccgttacggtcccc

SEQ ID NO: 397243 - DNA, 548 bp, Homo sapiens
  misc_feature: GZ8MTXP02FUCEG.3.79.H02.1.454.CMB.2.raw
  modified_base (246)..(246): a, c, t, g, unknown or other
  modified_base (300)..(300): a, c, t, g, unknown or other
  modified_base (440)..(440): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctggtaccaacaacaccaggcaaagccccaaactcatcatttangatgtcactgctcggccctcgtaggggtttctcatcgtccttttctgctcaagtctggcaccacggcctccctgaccatctcggggctccgaggctgaggacgaggctgcttatactgcagctcatacgtaacaaggacncaccaactcgtcgtggtatttcgggtaggacgggaccaaagtctacgtaacccgtccgttaaggaacgacggacccaaacgggccttccggcccccgttacggttccc

SEQ ID NO: 397244 - DNA, 557 bp, Homo sapiens
  misc_feature: GZ8MTXP02JRXBH.3.79.H02.1.454.CMB.2.raw
  modified_base (247)..(247): a, c, t, g, unknown or other
  modified_base (401)..(401): a, c, t, g, unknown or other
  modified_base (457)..(457): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtacacacaccagcaacgccccaaactcatcatttatgatgtcactgctccggcccttcgtacggggtttctcgacttcgtccctttttcgcggtctaccgtaagtcttcgggccacccgacggtcccctccctgaaccctntccgtccggggctcccgagccgtgagggacgaggctcgctttatacctgcagtctntatatacaaggcacaccacttctggtcgtagttgggtaggacggtacgaagcgtcgacccgtcgtagcgacgtaccgacgccgtccgtccccgtcgtccc

SEQ ID NO: 397245 - DNA, 512 bp, Homo sapiens
  misc_feature: GZ8MTXP02FT60O.3.79.H02.1.454.CMB.2.raw
  modified_base (336)..(336): a, c, t, g, unknown or other
  modified_base (426)..(426): a, c, t, g, unknown or other
  modified_base (430)..(430): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctggtaccaacaacaccaggacaaacgacccccaaactcatcatttatgatgtcactgctcggccctcgtagggtttcncatcgtccttttctggctcaagtctgcaccacggcctccctgaccatcgtcgggctccgagctgaggacgagctgcttatactgcagctnatanacaagagcaccactctcgtgtagttggtaggaggaccagctcgaccgtctaggtcacgacccaagctacgcccctcggtacc

SEQ ID NO: 397246 - DNA, 552 bp, Homo sapiens
  misc_feature: GZ8MTXP02JVNYT.3.79.H02.1.454.CMB.2.raw
  modified_base (438)..(438): a, c, t, g, unknown or other
  modified_base (449)..(449): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctctgtacaacaacaccagcaaagccccaaactcatcatttatgatgtcactgctccggccctcgaggggtttctccatcgtcctttctggctccaagtctgccaccaccggccctccctcgacccagtccgtcggggcctcccgaggctggaggacgaggctgtcttattaccgtgccagcctnatatacgaagngacaccacgtctcgttggttaagtttgggtacggaggggtaccctaaaggcttacgaccggtctacggtcgacggacccgaacggctcgccccctcggtaccc

SEQ ID NO: 397247 - DNA, 544 bp, Homo sapiens
  misc_feature: GZ8MTXP02JXRKY.3.79.H02.1.454.CMB.2.raw
  modified_base (300)..(300): a, c, t, g, unknown or other
  modified_base (366)..(366): a, c, t, g, unknown or other
  modified_base (433)..(433): a, c, t, g, unknown or other
  modified_base (446)..(446): a, c, t, g, unknown or other
  modified_base (453)..(453): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctggcccagtctgccctgactcagcctgcctccgtgtctgggtctcctggacagtcgatcaccatctcctgcactggaaccaacagtgacgttgattttttatatctcttgtctctggtaccaacaacaccagacaagcccccaaatcatcatttangatgtcactgctcgggcccctgtaggggtttctcatcgtccttttctggctccaagtctggcaccncggccctccctgaccatctcggggctcccgaggctggacggacgagggctggcttaattactgcagntcatatacaaggncacactntacggtgttaacgtttggtggacggaccaaaggcttacggacccgtctaggtcacgtccccgaaaggcctacggcccccctcggggtaccc

SEQ ID NO: 397248 - DNA, 597 bp, Homo sapiens
  misc_feature: GZ8MTXP02GAT6J.3.79.H02.1.454.CMB.2.raw
  modified_base (246)..(246): a, c, t, g, unknown or other
  modified_base (251)..(251): a, c, t, g, unknown or other
  modified_base (303)..(303): a, c, t, g, unknown or other
  modified_base (351)..(351): a, c, t, g, unknown or other
  modified_base (445)..(445): a, c, t, g, unknown or other
  modified_base (468)..(468): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaccaacagtgacgttgtatttttanatctntgtctctgtacaacaacaccaggacaaacgacccccaaatcatctatttatnatgtcactgctccggccctcgtagggtttctcgtattcgtccttttcnggtctaccgtaagttccgtcggccacccgaccggtcccttccccgtcgaccctacgtccgtccgggggctacccgaggtccgtggacgggacgnggtctgtcttatacgtgcagctnatataacgaaggacaccgacctacttccgtagttacggttagtttggggtcgggaacgggtacgaacggtctacgggacccgtccgttacgaaccgacgacccgacggctacccgccccgtacggtccc

SEQ ID NO: 397249 - DNA, 523 bp, Homo sapiens
  misc_feature: GZ8MTXP02F4HNO.3.79.H02.1.454.CMB.2.raw
  modified_base (248)..(248): a, c, t, g, unknown or other
  modified_base (400)..(400): a, c, t, g, unknown or other
  modified_base (458)..(458): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccaacaacaccaggcaaagcccccaaactcatcatttatgatgtcactgctcgccctgtacgggtttctcatcgcttttctgtctcatctgcaccacggcctccctcgacactcgtcgggctccgagctgagaacgngctgcttatactgcagctacgatatacgaagcacaccactcgtacgtgttacgttggnggtacggacaagtcgtcgaccgtcgtacggtcacgacccgacggccgtccgcccccgtaggtccc

SEQ ID NO: 397250 - DNA, 762 bp, Homo sapiens
  misc_feature: GZ8MTXP02IJK82.3.79.H02.1.454.CMB.2.raw
  modified_base (247)..(247): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtacacaacaccagacaacgcccccaaatcatactattatagatcgtcactgcctccggtccctcgtacggggtttcctctacgtccgtccttttactcggtctccgtaagttccgtcgggcctacccgaccggtcccccttaccccctcgacctacgttcccggtaccggggtcctcccgtacgggcgttacgggaacggacggacgggtcgttacggtacctttaagttaccgttagacccgtaggtaccttaacctaaagtttaaacgtaaaccgtaaaacgggggacgaaccccgtaaccctaccgttaccgttaccgggttagggtttaaaccggtttttagggggtacgggggtaaaccgggggtaaaccgtaaaccgggtaacccgtttccgggtaaacccccggttaccgttaacggggttaacccgaacgggtaacccccggaaacgggggtcccctacccgggtaccccccccgttaacggggtttacccccg

SEQ ID NO: 397251 - DNA, 569 bp, Homo sapiens
  misc_feature: GZ8MTXP02H026J.3.79.H02.1.454.CMB.2.raw
  modified_base (248)..(248): a, c, t, g, unknown or other
  modified_base (301)..(301): a, c, t, g, unknown or other
  modified_base (346)..(346): a, c, t, g, unknown or other
  modified_base (365)..(365): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatcctcctgcactggatccaccggtgacgttgattttttanattctctgtctctgtaccaacaacaccagcaaacgccccaaatcatcatttangatgtcactgctcggccctcgaggggtttctcatcgtctttttcncggctaccagtctgcaccncggcctctcgaccatcgtcggggcctccgaggcgtgacggacgagtccgtgtactttattactcgtacagtctctatttacaagcagaccaccactcgacggttcttcgggaaaccttggggaacttaagggtacctaccgtccgtaaacggtcaacgtcccaacggaacccaacccgactcgtccaccttcttccgtaccccc

SEQ ID NO: 397252 - DNA, 829 bp, Homo sapiens
  misc_feature: GZ8MTXP02HLAUC.3.79.H02.1.454.CMB.2.raw
  modified_base (246)..(246): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacaacaccaggacaaacgcccccaaatcatcatttatgatgtcactgcctccggccctcgtaggggtttcctctacgttccgtccctttttccgtcggtccttaccgtaagttccttcgggccctaacccgaccggtccccttccccgtacgaaccccgtacgttcccggtccgggggtccttaccccggaagggtccgttacgggaacggggaccggtaacggggtccgttacggtaacccttttacgtttaaccgttcgggacccttaaacggtcccgtttaacctaaacgtttaaaaccgttaaaccggaaaacggggtacccgaacccgtaaacccccttaccgttacccggtttaccggggtttaggggtttaaacgggtttttcgggggaaacgggggtaaccggggtaaaaccccgtaaaacgggtcccgttaaaccgggtaacccccgggtttaccccggttaacggggttaaccccgaaaccggggttaaccccccgaaaacggggttcccccgtttacccccggtaccccccccgggtttacggttaccccccgg

SEQ ID NO: 397253 - DNA, 506 bp, Homo sapiens
  misc_feature: GZ8MTXP02HEJP3.3.79.H02.1.454.CMB.2.raw
  modified_base (339)..(339): a, c, t, g, unknown or other
  modified_base (427)..(427): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttaatctctgtctctgtaccaacaacaccagcaaagccccaaatcaatcatttatgatgtcactgctcggccctcgaggggtttctcatcgccttttcnggctccaagtctgggcaccacggcctcctgaccatctcgggctccagctgagacgaggctgcttatactgcagctcatatacaagganacacactctcgtagtagttggtggacggacagcgtacgaccgtcgtacgtcacgaccgacggctccgccccgtacgtcc

SEQ ID NO: 397254 - DNA, 564 bp, Homo sapiens
  misc_feature: GZ8MTXP02JQXV9.3.79.H02.1.454.CMB.2.raw
  modified_base (246)..(246): a, c, t, g, unknown or other
  modified_base (296)..(296): a, c, t, g, unknown or other
  modified_base (325)..(325): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtacacacaccagcaaacgccccaaactcatcatttangatgtcatgctcgccctgtacgggtttcncatcgtcctttctgtctccaagtctggccaccacggccctccctcgacctatccgtcggggcctccgaggtccgtggacgggtacgaggctggtcttacgtactcggctagtctcgtaatagtaacgaaaggacgaccaaccgtactcgttacggtagttagtttgggtcgggacggacgaacgtcgtacgaccggtcgtagcgtacgaccgtacggcgtcccgtccccgtcgtacccg

SEQ ID NO: 397255 - DNA, 681 bp, Homo sapiens
  misc_feature: GZ8MTXP02GKQO8.3.79.H02.1.454.CMB.2.raw
  modified_base (247)..(247): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctctgtacacacaccagcaacgccccaaactcatcattatgatgtcactgctcgccctcgtacggggtttctctatcgtccttttctggtctacctagtctggccacccgacggtccctccctcgaccctacgtccgtccgggggcttcccgacggtcgtacggacgggacggacggtcgtacgtacgtttacgttacgttgaccgtacggtccttactaattaacgttaaccgaaacggggacgtaccgaaccctaaaccgttccgttaccggtttacgggtttaaggttttacggggttacggggaacgggggtaacccgtaaaacggtcgtaccggtaaccggttacccgttaacggggttaaccgtaaccggacccgtaaacgggtcccgtaccggtccccccggtttacgggttacccccg

SEQ ID NO: 397256 - DNA, 594 bp, Homo sapiens
  misc_feature: GZ8MTXP02G27YX.3.79.H02.1.454.CMB.2.raw
  modified_base (247)..(247): a, c, t, g, unknown or other
  modified_base (252)..(252): a, c, t, g, unknown or other
  modified_base (347)..(347): a, c, t, g, unknown or other
  modified_base (451)..(451): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctntgtctctgtaccacaacaccagcaaacgccccaaactcatcatttatgatgtcactgctcggccctcgtaggggtttctctactcgtccttttcngtctccaagtctggccaccacggcctccctgaccatcgtcggggctccgaggcgtggacggacgacgggctgtctttattactgcagctacatagtacaagganacacctactcgttcgtggttacgtttggggtagggacgggtaaccgaaaggtccgttacggtacccgttaccggttaacgggtcccgtaacggacccccgtaaacgggtcccgttacccggtccccccgttacgggttccccc

SEQ ID NO: 397257 - DNA, 518 bp, Homo sapiens
  misc_feature: GZ8MTXP02I8FM6.3.79.H02.1.454.CMB.2.raw
  modified_base (246)..(246): a, c, t, g, unknown or other
  modified_base (304)..(304): a, c, t, g, unknown or other
  modified_base (348)..(348): a, c, t, g, unknown or other
  modified_base (428)..(428): a, c, t, g, unknown or other
  modified_base (439)..(439): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctggtaccaacaacacccaggcaaacgcccccaaactcatcatttangatgtcactgctcggccctctaggggtttctcatcgccttttcngctccaagtctggcaccacggccctccctgaccatcgtcggggctccgaggctgagacgaggctgcttatactgcagctnatatacaaggngcaccactcgtcgtgtatttgggtgaggaccaagcgtacgaccgtctaggtcacggcccaggcctcgccccgtggtacc

SEQ ID NO: 397258 - DNA, 594 bp, Homo sapiens
  misc_feature: GZ8MTXP02HXBJR.3.79.H02.1.454.CMB.2.raw
  modified_base (240)..(240): a, c, t, g, unknown or other
  modified_base (297)..(297): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaccagcagtgacgttgganatataattatgtctctgtaccagcagcaccaggcaaacgccccaaatcatgatttangaggtcacaaaagcggccctcgaggggtccctgatcccgcttctctcgcctccaagtcgtggacaaccaccggccctccctgaccctctcgtcggcctcagcccgttgacggtagtcgaggtctaggtaactttattacgttgactagtctaccgaattgtcgacgtaggactaataccaaccgtactttacgggttttaccgggacgggtaacggggaaccaaacggtcgtaccggtacccgttccgtaacgggtcccgacggtaccccgaacgggtcccttcccggtaccccccg

SEQ ID NO: 397259 - DNA, 631 bp, Homo sapiens
  misc_feature: GZ8MTXP02I3171.3.79.H02.1.454.CMB.2.raw
  modified_base (341)..(341): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctgtacacaacaccagcaaacgccccaatcatcattatgatgtcactgctccggcctcgtacgggtttctcatcgtccttttcncgtctacctaagttccgttcggccacccgaccggtcccttccccgtacgaccctacgtccgtccgggggccttcccgagggtcgtggagggacgacggtctagtcttaagttctgctagcttacattacgacgaaggacaccacctacgtcgttacggtggttacgtttaggggtacggtacgggaaccgtaaacggtccgttacggtaacccggttccgtaacgggttaaccgaaccggttacccgaaaccgggtcccgtacccggtcccccggttccgtttaaccccg

SEQ ID NO: 397260 - DNA, 631 bp, Homo sapiens
  misc_feature: GZ8MTXP02H4LP4.3.79.H02.1.454.CMB.2.raw
  modified_base (245)..(245): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaccaacagtgacgttgatttttanatctctgtctctgtaccaacaacaccagcaaacgccccaaatcatcatttatgatgtacactgcctcggcccttgtacggggtttctcgactcgtccttttctggtcctacctaagtcttcggccaccgtaccggtcccctccgtcgacccattcccggtccggggtctccgacggctaggaacgggacggaggtctggtacctttattacgtgcaagtcttacataacgtacgaaaggacacctaaccacttccgttagtagggtttacgtttgggggtacgggtaacgggtaacgtaaacggtccgtacggtaacccggttccgtacgggtaaccgaccggaacccgtaacgggccgtaccccggtccccgtcgggttaccccg

SEQ ID NO: 397261 - DNA, 675 bp, Homo sapiens
  misc_feature: GZ8MTXP02ICDQ3.3.79.H02.1.454.CMB.2.raw
  modified_base (247)..(247): a, c, t, g, unknown or other
  modified_base (302)..(302): a, c, t, g, unknown or other
  modified_base (441)..(441): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaaccaacagtgacgttgtatttttanatctctgtctctgtaccaacaacaccaggacaaacgccccaaactcatcatttangatgtacatgctcggccctgtacgggttctctattcgtcccttttcgtcggtctacctaagtccgttcgggccaacccgacggtcccctccctcgacccattccgtccggggactccgaggccgtaggacgggaacggnggtaccgtggtactttacgttacgtcggactacgctttacaattaacgtaaacgaacgggacaccctaaccctaacgttccgttccggtttaggggttaacgtttttgggggaacgggtacgggggaaaccctaaagggtccgttaccgtaacccggttccgttaacggtaacccggtaacgaaccccgggttaacggcccgtttccccgaacccccggtttaccggttccccg

SEQ ID NO: 397262 - DNA, 604 bp, Homo sapiens
  misc_feature: GZ8MTXP02IQ5Y6.3.79.H02.1.454.CMB.2.raw
  modified_base (246)..(246): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcacatctcctgcactggaaccaacagtgacgttgtatttttanatctctgtctctggtacacaacaccagcaaacgcccccaaatcatcattatgatgtacactgcctcggcccctcgtaggggttttcctcgtacttcgtcctttttctcggtctcctaagtctcggccaccaccgggccctccctcgaaccctacgtccgtcgggggctcccgaggcgtggagggtacgaggtctggtacttattactgctagctacattacgtaaacaaggacacacctaactcgttacgtgttaagtttcgggagggtacgggtaccgaaacgtcgtacgtacccgttccgtaacggtccgaaccggacccgaaacgggtctcccggtcccccgttcggttaccccg

SEQ ID NO: 397263 - DNA, 550 bp, Homo sapiens
  misc_feature: GZ8MTXP02HS05H.3.79.H02.1.454.CMB.2.raw
  modified_base (245)..(245): a, c, t, g, unknown or other
  modified_base (445)..(445): a, c, t, g, unknown or other
  modified_base (454)..(454): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacaacaccaggcaagccccaaatcatcatttatgatgtcactgctcggccctcgtaggggtttctcattccgtccctttttcgtcggtcctcctaagtccttgggccacccgacggccctcccgtgacccatccgtcggggctccgagctgaggacgaggctgcttatactgcagctcatanacaaggacncaccatcgtgtaggttagtttgggtgggacgggaccaaggcgttacggaccgttccgaggtccgacgaccccgaggcctccgcccccgtggtaccc

SEQ ID NO: 397264 - DNA, 681 bp, Homo sapiens
  misc_feature: GZ8MTXP02GY35P.3.79.H02.1.454.CMB.2.raw
  modified_base (241)..(241): a, c, t, g, unknown or other
  modified_base (307)..(307): a, c, t, g, unknown or other
tcagagacgcactccacgaccggtgctcgatttagtgtcacacgaagggaaagggggggtctcaggaggcagcgctctcgggacgtctccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacagttggntaattataactatcgtctcctggtacagcagccaccaggacaaacgcccccaaatcatgtatttangagtcaacaaacgcgccctgacgggtccctagactcgtcttccctctacgtcctaccgaagttccgcgggaccaaaccgccggcccttacccgtagtacccgttcctcgtcgggtcctcccgaacgcccgtaggaacggacgtacggcttaggtactttacgttctcggtctaacgtccttactaactaaccgaaaccgaaccccggactaacccgtacgttcggttcgggtttacgggtttacggggtaagggtaaccgggtaacctaacggtccgttacgggtaacccgttccgtaaacggtccgaaccggtaacccggaacggtcccgtttaccccggacccccgtttcggttacccctacgtttccccgg

SEQ ID NO: 397265 - DNA, 518 bp, Homo sapiens
  misc_feature: GZ8MTXP02IYS1H.3.79.H02.1.454.CMB.2.raw
  modified_base (246)..(246): a, c, t, g, unknown or other
  modified_base (345)..(345): a, c, t, g, unknown or other
  modified_base (398)..(398): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccacaacaccaggcaaagcccccaaatcaatcatttatgatgtcactgctcggccctcgacggggtttctcatcgtccttttcnggctccaagtctggcaccacggccctccctgacagtctcggggctccgaggcnggagacgaggctgcttatactgcagctcatatacaagagcaccactctcgtggtatttggtggaggaccagctcgaccgtcgtagtcgacgacctaacggcctacgcccccgtcggtacc

SEQ ID NO: 397266 - DNA, 520 bp, Homo sapiens
  misc_feature: GZ8MTXP02ITVGG.3.79.H02.1.454.CMB.2.raw
  modified_base (246)..(246): a, c, t, g, unknown or other
  modified_base (347)..(347): a, c, t, g, unknown or other
  modified_base (406)..(406): a, c, t, g, unknown or other
  modified_base (464)..(464): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctgtaccaacaacaccaggcaaacgcccccaaatcatcatttatgatgtcactgctccggccctgtacgggtttctcatcgtccttttcngtctccagtctgcaccacgcctccctgaccatccgtcggggctccgagctggaggacgnggctgcttatactgcagctcatataacaggacgcaccactcgtcgtgttagtttgggnggaggacaagctacgaccgtcgtagtcgacgaccgaggcctaccgccccgtcgtcc

SEQ ID NO: 397267 - DNA, 844 bp, Homo sapiens
  misc_feature: GZ8MTXP02FR25B.3.79.H02.1.454.CMB.2.raw
  modified_base (246)..(246): a, c, t, g, unknown or other
  modified_base (318)..(318): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctcctgtaccaacaacaccagacaaacgacccccaaactcaatctaatttatagatgtcacgtncttccggccctcgtacggggttttcctcgacttccggtcccttttttcgtcgggtacctcccgtaaacgttcctacggggtacccaaccccgtaaacccggggtcccccttcccccgtaccggtaaccccctaacgttccccggttacccgggggggtccccttacccccggtaaacggggcccgttagggtaaaccgggggtaaacccgggaacggggtccgttacgggtaccttttaaacgtttaacgttcggcctaacgggttaccctacctaaaatttaacgttaaaaaccgaaacggggtaaacgtacccaaaacccgtaaccttaccgtttccggggtttaggggtttaacggttttttaacgggggcgggggtttaaaacgggggaaaccccttaaaaggggacccgtttaccgggaaacccccggtttaccgtttaaaaccgggggtcccctaaacgggtaacccccggaaacgggtccgtttaaccccggcccccccggtttcggtttaacccccgg

SEQ ID NO: 397268 - DNA, 505 bp, Homo sapiens
  misc_feature: GZ8MTXP02G0Q46.3.79.H02.1.454.CMB.2.raw
  modified_base (246)..(246): a, c, t, g, unknown or other
  modified_base (438)..(438): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccacaacaccagcaagcccccaaactcatcatttatgatgtcactgctcggccctcgtaggggtttctcattcgccttttctgctccagtctggcaccacggcctccctgaccatcctcggggctcccgaggcctgaggacgaggctgcttatactgcagctacatataacaaggancacactctcgtgtattggtggaggacaagctcgaccgtcaggtcacgccaggctcgcccctcggtcc

SEQ ID NO: 397269 - DNA, 661 bp, Homo sapiens
  misc_feature: GZ8MTXP02G6PRP.3.79.H02.1.454.CMB.2.raw
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctgtaccaacaacaccagcaaacgcccccaaatcatcatttatgatgtcactgctccggccctgtacgggtttctcacttcgtccctttttcgtggtcctccgaagttcctcgggtccaacccgacccggtcccctacccctcgaccctagtcccgtaccgggggtccttcccgaggtcgtggacgggacgacggctggtactttatacgtcgcacgtcttacaattacgtaaacgaaagggaccgacctaacccgtaaccgttccgttacgggttacggtttaaggttttacggggacggggtaacgggaacccgtaaaggtccgtacggttacccggtaccgttaacgggtccgaaccgtacccggaaacggtcctccccggtcccccgttcggttaccccg

SEQ ID NO: 397270 - DNA, 510 bp, Homo sapiens
  misc_feature: GZ8MTXP02GMCQ6.3.79.H02.1.454.CMB.2.raw
  modified_base (339)..(339): a, c, t, g, unknown or other
  modified_base (414)..(414): a, c, t, g, unknown or other
  modified_base (420)..(420): a, c, t, g, unknown or other
  modified_base (424)..(424): a, c, t, g, unknown or other
tcagagacgcactccacgaccggtgctcgatttagtgtcacacgaagggaaagggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctctgtacaacaacaccaggcaaacgccccaaatcatcatttatgatgtcactgctcggccctcaggggtttctcatcgccttttcnggtctcaagtctggcaccacggcctccctgacatctcgggctccgagctgacgcgagctgcttatactgcagctnatatanaagngacaccactcgtcgtgtagtttcggtggaaggaccaaagctcgaccgtcgtaggtcacggccaacggctaccgcccctacggtccc

SEQ ID NO: 397271 - DNA, 550 bp, Homo sapiens
  misc_feature: GZ8MTXP02G33V0.3.79.H02.1.454.CMB.2.raw
  modified_base (249)..(249): a, c, t, g, unknown or other
  modified_base (379)..(379): a, c, t, g, unknown or other
  modified_base (400)..(400): a, c, t, g, unknown or other
  modified_base (443)..(443): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtattttttanattctctgtctcctggtaccaacaacaccaggacaaacgacccccaaatcatcactttatgatgtcatgctccggccctcgtaggggtttctctatcgtcctttctgctccaagtctgcacacgcctccnacatcgtcggctccgagtcgnggagacggacggcctggtcttacgttactcgtacgaacgcctnaatactaacgaaaggacgacaccaactctcgtagttacgttggtaggacggacaagcgtacgaccgtcgtacgggtcacgaccaggcctccgccccgttacgtcccg

SEQ ID NO: 397272 - DNA, 564 bp, Homo sapiens
  misc_feature: GZ8MTXP02INXWR.3.79.H02.1.454.CMB.2.raw
  modified_base (247)..(247): a, c, t, g, unknown or other
  modified_base (454)..(454): a, c, t, g, unknown or other
  modified_base (469)..(469): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctctgtctcctggtaccaacaacacccaggacaaacgccccaaactcatcatttatgatgtcactgctccgccctcgtaggggtttctctactcgtccttttctggtctacctaagtcttcggccacccgacggccctccccgtacgacccactccgtccgggcctcccgaggctggaggacgaggctgacttatctgcagactnaatataacgaagganaccaccactctacgtgtacgtttggaggaggtaaccagcgtcgaccgtccgtaaggtccgacgtaccgaacggcctaccggtcccctcggtaccc

SEQ ID NO: 397273 - DNA, 728 bp, Homo sapiens
  misc_feature: GZ8MTXP02JI49Q.3.79.H02.1.454.CMB.2.raw
  modified_base (246)..(246): a, c, t, g, unknown or other
  modified_base (296)..(296): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtattttanatctctgtctctgtaccacaacaccagcaacgccccaatcatctatttantatgtcacgtcgctccggtccctcgtacgggtttctctatcgtccttttcgtcgtcctaccgtaagtccgtcggcctacccgtaccgggtccctcccctacggaccctacgttcccggtaccgggggtccttcccgacgggcgtagggacgggacgcgggtctcggtacttacgttacgtacgccgtaggtacccttacgtaacttaacgtaaaccggtaacggtaaccggaccctaaaccctaacgttccgtttaggggtttaacggggtttaagggttttcgggggaaacgggggtaaccggggtaaacccggtaaacggtccgggttaccggtaaaaccccggttcggtaaaccgggtccgtaaaaccggaccccggtaaacgggtcccccgttccccgggtaaccccccggttcggtttaaccccccg

SEQ ID NO: 397274 - DNA, 673 bp, Homo sapiens
  misc_feature: GZ8MTXP02F2HU5.3.79.H02.1.454.CMB.2.raw
  modified_base (249)..(249): a, c, t, g, unknown or other
  modified_base (305)..(305): a, c, t, g, unknown or other
  modified_base (339)..(339): a, c, t, g, unknown or other
  modified_base (355)..(355): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttanatctctgtctctgtaccacaacaccaggacaaacgcccccaaactcatctatttanagtatgtcactgctccggcctcgtacgggtttcnctatccgtcttttcgnggtctacgtaagtccgttacgccgaccgaccggtccctccctacgacctcgtccgtcggggtctccgagctaggaggtaccgaggtcttgtacttacttctaggcctagctacagttaacgaacgaaggcaacctaccgtaacgttcccgtacggtttagggtttaagtttacgggggtaacgggttaacgggaaaccccttaaagggccgtttaacccggtaacccgttaccggtttaaaccggaaccgttaacccgggaaaccccggtaacgggttcccccgtcccgggttaccccccgtaacgggtttacccccg

SEQ ID NO: 397275 - DNA, 630 bp, Homo sapiens
  misc_feature: GZ8MTXP02IJ2GM.3.79.H02.1.454.CMB.2.raw
  modified_base (246)..(246): a, c, t, g, unknown or other
  modified_base (314)..(314): a, c, t, g, unknown or other
  modified_base (431)..(431): a, c, t, g, unknown or other
  modified_base (435)..(435): a, c, t, g, unknown or other
  modified_base (458)..(458): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctcgtgtctgggtctcctggacagtcgatcaccatctcctgcactggaaccaacagtgacgttgtatttttanatctctgtctcctggtaccaacaacaccaggacaaacgacccccaaatcactctatttatgatgtacnctgcctccggaccctcgtagggtttctcatcgtcctttctgctacagtctcgcaccaccggcctccctcgacatcgtcgggctccgagcgtgaggacgagtcgtgtcgttatacgtnacgngtctacagttacaacgaacgganaccctaacgacttcgttaccggtaggtttaacgtttaggggttacgggaacggggacccgtaaaagggtccgttacgggtaaaccccggttccgtttacgggtaacccgtaaaccggtaccccggaaaacggtccgtaaccccggtacccccggtttaccgggtttaccccg

SEQ ID NO: 397276 - DNA, 544 bp, Homo sapiens
  misc_feature: GZ8MTXP02J09A1.3.79.H02.1.454.CMB.2.raw
  modified_base (248)..(248): a, c, t, g, unknown or other
  modified_base (303)..(303): a, c, t, g, unknown or other
  modified_base (332)..(332): a, c, t, g, unknown or other
  modified_base (343)..(343): a, c, t, g, unknown or other
  modified_base (353)..(353): a, c, t, g, unknown or other
  modified_base (376)..(376): a, c, t, g, unknown or other
  modified_base (429)..(429): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtcctgccctgactcagcctgcctccgtgtctgggtctccgtggacagtcgatcaccatctcctgcactggaaccaacagtgacgttgatttttanattctctgtctctggtaccaacaacacccagcaaagcccccaaatcatcatttangatgtcactgctcggccctgagggtttcncatcgctttcngctacagtcnggccaccacggcctcctgacctntcgcggggcctcgaggctgagcgaggctgccttatactgctagctacattaanacgaaggcaccaccgtactctacggtggttaatttggggtggaacggacctaaaggcgtacggaccgttccgtaagggtccacggcccaacgggtctccggcccccttaggtccc

SEQ ID NO: 397277 - DNA, 559 bp, Homo sapiens
  misc_feature: GZ8MTXP02HUQLI.3.79.H02.1.454.CMB.2.raw
  modified_base (245)..(245): a, c, t, g, unknown or other
  modified_base (301)..(301): a, c, t, g, unknown or other
  modified_base (331)..(331): a, c, t, g, unknown or other
  modified_base (345)..(345): a, c, t, g, unknown or other
  modified_base (361)..(361): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcccgcctccgtgtctgggtctcctggacagtcgatcaccatctcctgcactggaaccaacagtgacgttgatttttanatctctgtctcctggtaccaacaacacccaggcaaagcccccaaatcatcatttangtatgtcactgctcggccctgagggtttcnctatcgtcttttcngcctcaagtctcggcnccacgtcctcctgaccatccgtcggggctccgaggctgaggacgaggctgcttatactgacctagctacaatatacgaaagacgaccaaccactcgtacgttaggttagttgggttaggaacgggtaaccaaacggcttacggacccgtcgtacggtcaacgtcccaaacgggtcctacgccccctaggttacctccg

SEQ ID NO: 397278 - DNA, 677 bp, Homo sapiens
  misc_feature: GZ8MTXP02F4IWC.3.79.H02.1.454.CMB.2.raw
  modified_base (250)..(250): a, c, t, g, unknown or other
  modified_base (255)..(255): a, c, t, g, unknown or other
  modified_base (449)..(449): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactaggaaccaacagtgtacgttgttatttttanatctntgtctctgtacaacaacaccagacaaacgaccccaaatcatctaattatgatgtctactcgaccgtcccgtccctaggtacgggtttcctcgtacttcgttcctttcgcgtctacgtaacgtcgtcgccaccgccgtcctccgactaccacgtcggtaccgggtcctaccggacggtcgtaggacggtaacggnggtcttacggttactttacgttctacggtacctacggtacctaacgtaacgttaaacgtaaccgtaaacgggtaccaaccggtaacccttaacgtttcccggttagggtttacgggtttaacgggtttacgggggtaacgggtaaccggaaaccggtacgtacggtaccggtacccgtacggtacgtaaccgaccgtacgaccgtccgtaccggcccgtacgtacccg

SEQ ID NO: 397279 - DNA, 550 bp, Homo sapiens
  misc_feature: GZ8MTXP02IDZ7S.3.79.H02.1.454.CMB.2.raw
  modified_base (240)..(240): a, c, t, g, unknown or other
  modified_base (383)..(383): a, c, t, g, unknown or other
  modified_base (431)..(431): a, c, t, g, unknown or other
  modified_base (458)..(458): a, c, t, g, unknown or other
tcagagacgcactccacgaccggtgctcgatttagtgtcacacgaagggaaaggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacattggtnattataactatgtctctggtaccagcagcacccagcaaagcccccaaactcatcatttatgatgtcactgctcggccctgtacggggttctccgatcgtcttttctggctccagtctggcacccaccggcctccctgacccanccgttcggggctccgagcgtgagggacgagggcctgactttagttacngtacagtctacataactacaaaggacncacgactctacggtaggtatttgggtaggacgggtaccgaacgtcgtacgtaaccgtccgtacgggtacacggtacctaacgggcctcccgg

SEQ ID NO: 397280 - DNA, 577 bp, Homo sapiens
  misc_feature: GZ8MTXP02F9TCG.3.79.H02.1.454.CMB.2.raw
  modified_base (253)..(253): a, c, t, g, unknown or other
  modified_base (441)..(441): a, c, t, g, unknown or other
  modified_base (446)..(446): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgtatttttatatctntgtctctggtaccaacaacaccaggacaaacgccccaaactcatcatttatgatgtcactgctcggccctcgagggtttctcatcgtccttttctcggtctctaagtctggccaccgacggtcctccctgacccatccgtcggggcctccgacgctaggagacgaggctgtcttatactgcagtctanactanaacaaggacacacacgtcacgtgtaagtttggtgggaagggaccctaaaggtccgtaggtaacccgtccgttaacgggtaacaccgacccgaaaacgggccctttaccggccccccgtcggtttaaccccc

SEQ ID NO: 397281 - DNA, 632 bp, Homo sapiens
  misc_feature: GZ8MTXP02IVW7R.3.79.H02.1.454.CMB.2.raw
  modified_base (241)..(241): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatatatatgtctctgtaccacaactccaggcaacgccccaaactgactgatttatgatgtacaataactcggccccttagtaaggggttttcaactcgctttactccgtcggacctccgaagtctacggcacaccgggcctacccctgacctacgtcctcgtcggtacctaccggagggtacgacggacgtagcgttagtaacgtttactacgttacggactacggtacttaccgtaataccgtacgtacgaccgtaaccaaccctacgtacgtaacgggttaccgttacggaacgttacgggtaaccgtaacggtaccgtacccgtacgttacgaccacccgaccgaacccgaaccctacccgtacgtactaccctacttacttaccccg

SEQ ID NO: 397282 - DNA, 565 bp, Homo sapiens
  misc_feature: GZ8MTXP02JK6RS.3.79.H02.1.454.CMB.2.raw
  modified_base (270)..(270): a, c, t, g, unknown or other
  modified_base (337)..(337): a, c, t, g, unknown or other
  modified_base (415)..(415): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgaacgttgtatttttatatctctgtctctggtaccaanaacaccaggacaaacgcccccaaactcatcatttatgatgtcactgctccggcctctaggggtttcncatcgtcctttctggtctcaagtctgcaccacggcctccctgaccactcgtccgggctccgagcgtggaggacacggntacgtcttattactggcacgctacataataacaaagggcaccacctactcgttcggtaaggttgtttaggggtaggacggaacgtacgacgttcgacccgtcgttaacggcgtacgacccgtaacggtccgtccgcccccgtgtaccccg

SEQ ID NO: 397283 - DNA, 611 bp, Homo sapiens
  misc_feature: GZ8MTXP02I7DMU.3.79.H02.1.454.CMB.2.raw
  modified_base (249)..(249): a, c, t, g, unknown or other
  modified_base (254)..(254): a, c, t, g, unknown or other
  modified_base (301)..(301): a, c, t, g, unknown or other
  modified_base (347)..(347): a, c, t, g, unknown or other
  modified_base (377)..(377): a, c, t, g, unknown or other
  modified_base (428)..(428): a, c, t, g, unknown or other
tcagagacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctntgtctctgtacaacaacaccagacaaacgccccaaatcatcatttangatgtcactgctccggcctcgtagggtttctctatcgtccttttcnggtctcaagtctggcaccacggccttcccngacatccgtcgggctcccgaggctagacggacgaggctgaccttattacgngacgatctactaagttacaaacgaaggacacaccacgtccgttggttaggttaacgttttgggggacgggaacgggaacccgtaaaaggtccgttacggaaaccccgttccggttaaaacggtccgaaaaccggccccggaaaacgggtcccttaaccccggcccccggtttacggtaccccg

SEQ ID NO: 397284 - DNA, 717 bp, Homo sapiens
  misc_feature: GZ8MTXP02HAH6B.3.79.H02.1.454.CMB.2.raw
  modified_base (225)..(225): a, c, t, g, unknown or other
  modified_base (244)..(244): a, c, t, g, unknown or other
  modified_base (249)..(249): a, c, t, g, unknown or other
  modified_base (348)..(348): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctcgtgtctgggtctctggacagtcgatcacatctcctgcactggaaccaanagtgacgttgtaattttanatctntgtctctgtacaacacaccagcaaacgaccccaaactcatactacttatgtatgtcactgctcgtccctcgtacgggtttctcgtactcgtccttttcncgtctctaacgtctggccacccgaccggtcccttcccgtacgtaacccgtacgtcccgtccgggggccttacccggacggtacgtacggaacgggtaacggacggtcgtacggttactttaagttaacgtagtaacgtacctactaacgtaacgtaacggaaacgtaaccgacctaaacccgtacgttaccggtttaccggttagggttttaaggtttacggggttaacggggtaaaccggggaaacccgtaaacgggtaccgtacccggttaacccggtaacccgttaaccgggttaccgtaaaccggaccccgtaaaacggtacccgtcccggttaaccccccgttccgggtaacccgtttaccccg

SEQ ID NO: 397285 - DNA, 657 bp, Homo sapiens
  misc_feature: GZ8MTXP02FY1XW.3.79.H02.1.454.CMB.2.raw
  modified_base (226)..(226): a, c, t, g, unknown or other
  modified_base (240)..(240): a, c, t, g, unknown or other
  modified_base (304)..(304): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctaccctgactcagcctgcctccgtgtctgggtctcctggacagtcagtcaccatctcctgcactggaaccngcagtgacattggnattataactatgtctctggtaccagcagccaccaggacaaacgaccccaaatcatcgtatttangagtacaacaaacgccggcctcgacggggtccctgactccgtcttcctctcgtccctaccgaagttccgtcgaccaacgacccggtaccctcccgtacgacccgttctcgtcggtccctaccgacgtcccgtaggacggtagtacggacgggtctacgttaatttacgttaacgtcgtcgtacgtctacctaagttacgtacgcgtaaggacctaacgtaccgtaaaacgttcggtttacggttttaccgggaccggggtaacggaaaccgtacggtaccgttaccggtacccggttaaccgtacggtaccgtaccggaacccggtaaccggaccgttacccggttcccccgg

SEQ ID NO: 397286 - DNA, 695 bp, Homo sapiens
  misc_feature: GZ8MTXP02GFTLA.3.79.H02.1.454.CMB.2.raw
  modified_base (246)..(246): a, c, t, g, unknown or other
  modified_base (251)..(251): a, c, t, g, unknown or other
  modified_base (285)..(285): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctntgtctctgtaccaacacaccagcaacgccccaancatcatttatgatgtcactgcctccggccctcgtagggtttctctacttcgtcccttttcgtcggtcctaccgaagttccttcgggcctaacccgaccggtccctaccccgtacgaacccgtacgtccgtccgggggtccttacccgaggtccgtaggaacgggacgaacggggtcctacggtacttaacgttacgtggtacctaggtccttacaacgttaaacgtaacgaaacgggacgtaccaaccctaaccgtccgttacggtacgggtttacggtttaggggtacggggtaacgggtaaaccgtaaacggtccgttaccggaaacccgtttccgtaaacgggttaacccgtaacggaccccggtaaacgggtcctacccggtacccccggttcggtttaacccccg

SEQ ID NO: 397287 - DNA, 566 bp, Homo sapiens
  misc_feature: GZ8MTXP02FGBRI.3.79.H02.1.454.CMB.2.raw
  modified_base (247)..(247): a, c, t, g, unknown or other
  modified_base (252)..(252): a, c, t, g, unknown or other
  modified_base (301)..(301): a, c, t, g, unknown or other
  modified_base (335)..(335): a, c, t, g, unknown or other
  modified_base (351)..(351): a, c, t, g, unknown or other
  modified_base (381)..(381): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaaccaacagtgacgttgatttttanatctntgtctctgtaccaacaacaccaggcaaacgccccaaactcatcatttangatgtcactgctccgggccctcgtaggggtttcnctattcgtccttttcnggctccaagtctggccaccgacgcctcccngaccatcgtcggggctccgaggctggaggacgaggctcgtcttattactgacagctacgattaagtaacgaaaggacgacaaccactcgtacggtggttaagtttgggagggtacgggaccaaaggtctacggtacccgtccgttaggcacggacccgtaaggccctacgcccccgttggtaccc

SEQ ID NO: 397288 - DNA, 602 bp, Homo sapiens
  misc_feature: GZ8MTXP02INOJ1.3.79.H02.1.454.CMB.2.raw
  modified_base (358)..(358): a, c, t, g, unknown or other
  modified_base (374)..(374): a, c, t, g, unknown or other
  modified_base (448)..(448): a, c, t, g, unknown or other
tcagagacgcactccacgaccggtgctcgatttagtgtcacacgaagggaaagggtggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctctgcactggaaccaacagtgacgttgtattttatatctctgtctctgtacaacaacaccagacaaacgaccccaaatcatactatttatgatgtacactcgtactccggtcctagtacgggttctacgtattcccgtcttttccgngtacctactaagttcncggtccaacccgaccggtccctacccgtcgaacctacgtcccgtcggggcctccgacggtcgtaggacggacgngtcgtagtacttataccgtgactagtcctataataataacgaacgacgtacacctaactcgtagtcgttagttgggacgggtaacgaacgaacgtccgtacgacccgttacgtaacggtacacgacccgtacggcctaccggtcccccgtacgg

SEQ ID NO: 397289 - DNA, 766 bp, Homo sapiens
  misc_feature: GZ8MTXP02HL04L.3.79.H02.1.454.CMB.2.raw
  modified_base (301)..(301): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcacatctcctgcactggaaccaacagtgacgttgtatttttatatctctgtctctgtaccaacaacaccagacaaacgccccaaatcatctatttatnatgtcactgctccggtccctcgtacgggtttctctattcgttccttttccgtcggtcctacccgtaagttccgtcggcctacccgaccggtccccttccccgtaccgaccctacgttcccgtacccgggggtccttacccggacgggtccgtacggggaacgggaccggaacgggtccgttacgggtacctttaaacgtttaccgtcggtaccgtaacggtccttaacaaatttaacgtaaaaccgaaacgggtaacgaccctaaacccgtaccgttccgttacgggtttacggtttaacggttttacgggggtacggggtaaccgggggtaaaccgtaaacgggtccgttaaccggggtaaccccgttacccggttaacgggtaaccccgtaaccggtaacccccgggtaaaccgggtaccccgtttcccccggtaccccccggtttacccgggttaacccccg

SEQ ID NO: 397290 - DNA, 796 bp, Homo sapiens
  misc_feature: GZ8MTXP02IMED5.3.79.H02.1.454.CMB.2.raw
  modified_base (228)..(228): a, c, t, g, unknown or other
  modified_base (247)..(247): a, c, t, g, unknown or other
  modified_base (306)..(306): a, c, t, g, unknown or other
  modified_base (309)..(309): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcacatctcctgcacgtgaaaccaanagtgacgttgtatttttanatctctgtctctagtaccaacaacaccagaccaaacgacccccaaatcactctattatnatntcatgctccggcctcgtacggttctctactcgttcctttcgtcgtctacctacgttctcggaccctacccgaccggtcccccttccccgtacgtacccgtaacgttcccgggtacccgggtccgtacccggtaggtacccggtaggggtaaaccggggtacggtaccgggggttaccgttaccgggttacctttaaacgttaccgttaccggtaaccgtaacggtaccttaacttaagttaacgttaaaacccgaaacggtaccggaccctaacccgtaaccgttccgttacgggtttacgggtttaaacgggtttttcgggggtaacgggtaaaccggggttaaacccggaaacggttacccggttacccggggttaaaaccccgggtttcccggtaaaccggggtttaaccgaaccccggggttaaccccgtaaacggggtaccccgttccccggttaccccccgggttacggtttaaccccccg

SEQ ID NO: 397291 - DNA, 529 bp, Homo sapiens
  misc_feature: GZ8MTXP02JQPUN.3.79.H02.1.454.CMB.2.raw
  modified_base (323)..(323): a, c, t, g, unknown or other
  modified_base (346)..(346): a, c, t, g, unknown or other
  modified_base (441)..(441): a, c, t, g, unknown or other
  modified_base (459)..(459): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaacgcccccaaatcatcatttatgatgtcactgctcggccctnaggggtttctcattcgcttttcnggtctccaagtctggcaccgacggtcctcctgaccatccgtcggggctccgagctggagacgaggctgtcttatactgcagctcatatacaaggncacatctgtgtatttggnggaggacaagtctacggacctaccgtacggtcgaacgaccccgaaaggcctaccgcccccgtacggtccc

SEQ ID NO: 397292 - DNA, 662 bp, Homo sapiens
  misc_feature: GZ8MTXP02GHLQW.3.79.H02.1.454.CMB.2.raw
  modified_base (247)..(247): a, c, t, g, unknown or other
  modified_base (303)..(303): a, c, t, g, unknown or other
  modified_base (333)..(333): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttanatctctgtctcctggtacaacaacaccaggacaaacgccccaaactcatcattatnatgtcactgctcggccctgtacgggtttcnctactcggtcctttttcgcggtctcctaaggttcctcgacctaccgaccggcccttaccctcgaccctagtccgtcggggctacccgaggctaggagggacgacggtctacggtacttacttacgtcggctaacgcttacgaacttactaacgaaggacgaccaaccgtaaccgttcgttaccggttagggtttacgtttaccgggggttagggtaaaccggggacgtaaaaccggtcgtacccgggtaacccgtttaccgtaacgggttcccgaaacgccccggtaaaacggtcccggttcccggcccccgttaccgggttaaccccg

SEQ ID NO: 397293 - DNA, 553 bp, Homo sapiens
  misc_feature: GZ8MTXP02GC2T3.3.79.H02.1.454.CMB.2.raw
  modified_base (228)..(228): a, c, t, g, unknown or other
  modified_base (248)..(248): a, c, t, g, unknown or other
  modified_base (291)..(291): a, c, t, g, unknown or other
  modified_base (300)..(300): a, c, t, g, unknown or other
  modified_base (304)..(304): a, c, t, g, unknown or other
  modified_base (330)..(330): a, c, t, g, unknown or other
  modified_base (343)..(343): a, c, t, g, unknown or other
  modified_base (355)..(355): a, c, t, g, unknown or other
  modified_base (368)..(368): a, c, t, g, unknown or other
  modified_base (401)..(401): a, c, t, g, unknown or other
  modified_base (410)..(410): a, c, t, g, unknown or other
  modified_base (431)..(431): a, c, t, g, unknown or other
  modified_base (438)..(438): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaanagtgacgtttgtatttttanatctctgtctctgtaccaacaacaccaggcaaacgccccaaancatcattangatntcactgctcgccctcgtagggtttcncatcgtcctttcngctcagtctgcnccacggcctcccngaccatcgtcgggctcccgaggctggaggacgnggtctcgtnttagtctgcagtctcatacanaaggacncaacacgtctcgttaggtagtttgggacggtaggaccgtaaaggcttacgacccgttactacggggtaacaaccggaccgtaaacgggcctaccggtcccccgtcggttaccccg

SEQ ID NO: 397294 - DNA, 606 bp, Homo sapiens
  misc_feature: GZ8MTXP02I3Q35.3.79.H02.1.454.CMB.2.raw
  modified_base (496)..(496): a, c, t, g, unknown or other
tcagagacgcactccacgaccggtgctcgatttagtgtcacacgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgactattggtgattataactatgtctccgtgtaccagcagccacccgagaccaaacgacccccaaactcactagtatttagtcgaaggtacaaacgtaaacggcccggccctacggacgggtccctagactcgtcccttctctcgcctactaacgtctcggaccaaaccgccggtccctacccgtcgacccgttcctcgtcggtcctccgacgccgtagagtactaggacgtctagtatttacttatcgactagctatatacgngacgagactactaactacgtacgtttcgggtttaccggacgggtaacgtaaccgagtaccgtacgtaccgtacgaacgtcgacgaccgacgtcccgtccgccccgttacg

SEQ ID NO: 397295 - DNA, 747 bp, Homo sapiens
  misc_feature: GZ8MTXP02H38M0.3.79.H02.1.454.CMB.2.raw
  modified_base (253)..(253): a, c, t, g, unknown or other
  modified_base (319)..(319): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctccgtggacagtcgatccaccatcctctgcacgtggaaaccacagtgacgttagttatttttanttctcttgtcctcgtagtaccaaacaaccaccgagaccaaaccgacccccaaactcatctatttangtatcgtcactcgccgttacccggccccgttcggtacgggtttcctcgtacgtttcgttccctttttcgtccggtcctaccgtaacgttccgtacggcccgtaacccgacccggtcccccgttacccgtacccgtaccccgtacgtcccgggttcccggggtccctacccggacgggtccgtagggaacggtaaccggacgggtccttacgggttaactttacgttaccgtgtaccaggttctacgtaattaacgtaacgaaaggaccacctaaccgtactccggttaggttacggtttaacggtttcggggaacggggtaaaccggtaaccgtaaaccggtacgttacccggtaacccgttaccggtaacgtaaccgaacccggtaaccggaccggtcccgtacccccggtccccgtaccggtaccc

SEQ ID NO: 397296 - DNA, 709 bp, Homo sapiens
  misc_feature: GZ8MTXP02FV9ZR.3.79.H02.1.454.CMB.2.raw
tcagagacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatatctctgtctctgtaccaacacaccagcaaacgccccaaactcatctatttatgatgtcactgctccggccctcgtaggggtttcctctacgtcgtccctttttcgtcggcctaccgtaagtccgttcggcccacccgaccgggtccccttccccgtcgaaccctctccggttccgggggccttcccgtaacggggccttagggaacggggaccggaaggggtccgttacggtcctttaaactttaccgtcggacctacggtaccttcgtaaattaacgtaaaccgaaagggacgacccaacccgtaccttccgttaccggttagggtttaagttttcggggtaggggaacggggtaaacccgaaaggtccgtacggtaaaccccgtccggttaacgggtaaccgaaccgggaccccgtaaaacggggtccctacccggtcccccccgttacgggttacccc

SEQ ID NO: 397297 - DNA, 558 bp, Homo sapiens
  misc_feature: GZ8MTXP02IZAV1.3.79.H02.1.454.CMB.2.raw
  modified_base (248)..(248): a, c, t, g, unknown or other
  modified_base (299)..(299): a, c, t, g, unknown or other
  modified_base (309)..(309): a, c, t, g, unknown or other
  modified_base (464)..(464): a, c, t, g, unknown or other
  modified_base (468)..(468): a, c, t, g, unknown or other
  modified_base (476)..(476): a, c, t, g, unknown or other
tcagagacgcactccacgaccggtgctcgatttagtgtcacacgaagggaaagggggggtctcaggaggcagcgctctcgggacgtctccaccatggcctgggctctgctattcctcacccctcctcactcaggcacagagtcctgggcccagtctgccctgactcagcctgcctccgtgtctgggtctcctggacagtcgatcaccatctcctgcactggaaccaacagtgtacgttgtatttttanatctctgtctctgtaccacaacaccagacaacgaccccaatcatcatttangatgtcactncgtccggccctgtagggtttctcatcgtcctttcgcggtcctacctagtcctcgggccaccgtaccggccctcccgtacgaccctacgtcccgtccgggggacctccgagggtcctgggaacgacgacggtctacgtcttatactgctagcttanatanacgaagcncacctattcgtcgtgttagttagggagacggtacagctcgaccgtacgagtaacacgtaccaggtcctaccgcccgtcgtcc

SEQ ID NO: 397298 - DNA, 655 bp, Homo sapiens
  misc_feature: GZ8MTXP02IEN8G.3.79.H02.1.454.CMB.2.raw
  modified_base (254)..(254): a, c, t, g, unknown or other
  modified_base (258)..(258): a, c, t, g, unknown or other
  modified_base (310)..(310): a, c, t, g, unknown or other
  modified_base (364)..(364): a, c, t, g, unknown or other
  modified_base (453)..(453): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctccgtggacaggtcgatcaccatctcctgcactaggaaaccaacagtagacgttgtattttttantctntgtctctgtaaccaacaacaccagacaaacgccccaaatcaatgtatttagngacgtacgaacaacggccggccctacggacgggttcccagtactcgtctttccncctcgcccctacgaagttcgtacggaccacgtcccgtaccctccccgtagtaccccgttcgtcgtcggtcctccgacgtcgtggacggngtggacggtcttagtaactttacttagtcgactagtacttacgtattacgtagacgacggactacgtaacctacgttaacggtttcgggtttacccgggggaacgggtacgggaaccgtacggttaccgaccggtaccgtaccgttacgaccgaaccggtacccgaacggtcctccccggtccccggtacgttccgtacccg

SEQ ID NO: 397299 - DNA, 650 bp, Homo sapiens
  misc_feature: GZ8MTXP02HAT8K.3.79.H02.1.454.CMB.2.raw
  modified_base (230)..(230): a, c, t, g, unknown or other
  modified_base (247)..(247): a, c, t, g, unknown or other
  modified_base (315)..(315): a, c, t, g, unknown or other
  modified_base (538)..(538): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacngtgacgttgatttttanatctctgtctcgtagtaccaacaacaccacgacaaaccgacccctaaactctatactattatgtactntactactcgtccgtcccgtccgttacggttacggttctacgtacttccgttccctttcgtacgtactaccgtagttccgtacggcctacccgtaccggtcccctaccgtacgtaccgtacgttccggtccggggtcctaccggtacgcgtaggacggtacgtacggtactacgtacttagtacgtacgacgtacgtctaacgtactaacgtaaacgacgtacncctaacgtcgttcgtggtacgttagttcgggggaacggtacggactaacgtccgtaacggtaccttcggaacgtcgaaccgtaccgacgtccgtacctccccggtactaccg

SEQ ID NO: 397300 - DNA, 618 bp, Homo sapiens
  misc_feature: GZ8MTXP02I7M3H.3.79.H02.1.454.CMB.2.raw
  modified_base (230)..(230): a, c, t, g, unknown or other
  modified_base (251)..(251): a, c, t, g, unknown or other
  modified_base (283)..(283): a, c, t, g, unknown or other
  modified_base (306)..(306): a, c, t, g, unknown or other
  modified_base (311)..(311): a, c, t, g, unknown or other
  modified_base (464)..(464): a, c, t, g, unknown or other
tcagagacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctccgtggacagtcatcaccatctctgcactaggaaccaacngtagtacgttgtaatttttanacgttctcttgtcttcctggtaccaacaaacnccgagacaacgccccaaatcatnattangtatgtacatgcctcgacctgtacgggttctcactcgtactttcgacgtctacctaggtcctgacctaccgtccggtccctccgactaccacgtccgtcggggtactcccggaggtacctagggacgacggtacgtcgtgtacttacgttacnggctacgactctaagttaacgacgtaacggtacacctacgacgttctcggttagttacgttacgggtagggtaccggacgtaacgtacgtacgtaccttacggttacgcgtaacgtcccgtaaacggtcctccggtccccgtacggttaccccg

SEQ ID NO: 397301 - DNA, 634 bp, Homo sapiens
  misc_feature: GZ8MTXP01ASTTT.3.39.D06.1.454.CMB.2.raw
  modified_base (163)..(163): a, c, t, g, unknown or other
  modified_base (214)..(214): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagcggtgttcgtntaggctttcaaagtgtcagtgtgagtgcagatggtggagagtggaggaggngtgatcgacggccggggtccgtgacgactctctatagtacgacgctcgtgtagtcacgcgtactaactaaactactacatgagcgtcggtccgccgacgcgtcggagggagggtacggtcggtcggtcggtcgtcgtagtacgtacgagtagagtagtaagtaatataatagtagtacgacgtacgtacggtacggacgggtacgtactactacctactacctaccgacgaacgtaactaactaactaaacgaactactacgttacgttacttacttaactaactaacgaacgacgtacgtacgacggtacggaccggacggaccgtaaccgtacttacttacgttacgtcgtcgttcggacggacggtaacgtacgggtaacgggacgggtacggttacgttaacgttaacgttaacgg

SEQ ID NO: 397302 - DNA, 632 bp, Homo sapiens
  misc_feature: GZ8MTXP01D14F5.3.39.D06.1.454.CMB.2.raw
  modified_base (428)..(428): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctttttcaaaaggtgtccagtgtgaggtgcagatggtggagactggaggaggcttgatccgaggccgggggggtcctgagactctcatgtacaggctctgagttcagcgtacaactaaatactacatgagctgggtccgccaggctcgaggggagggactggactgggtctccgagtgttaaaccgagcgaatggaagtaacattaatatgcagactcgtagaagggccattcaccatctacaagagaacataccaaanacacttctagtacttacttaacaaatacgaaacacgaccgtaggaacgacggacccggaacgtaaccgtaacccggttcccttttaaacgttacgttacggtaaccgtaaccgttaaaaacccgttacgttaccgtaaacgtaaacgttaaaccgtacgggtaaaaccgtttacgggggttaacgggttaacggtaaccggggg

SEQ ID NO: 397303 - DNA, 564 bp, Homo sapiens
  misc_feature: GZ8MTXP01B2935.3.39.D06.1.454.CMB.2.raw
  modified_base (266)..(266): a, c, t, g, unknown or other
  modified_base (562)..(562): a, c, t, g, unknown or other
  modified_base (564)..(564): a, c, t, g, unknown or other
tcagagacgcactccacgaccggtgctcgatttagtgacatctcgcagttctttgggttttgggggtccctgagactctcatgtacaggctctgagttcagcgtcactaaatactacatgagctgggtccgccaggctccgagggaggggactggactgggtctccagtgttaacagcgatggaagtacatattatgcagactcgtgaaggccattcacatctccagagacaattccaagaacactctgtatcttacaaatgaacngcctgagagccgaggacacgccttctattactgtgcgagcgatcgacgggcgagtctgattactttcgtggggcagggaccctggtccaccgtctcctcacgcccctaccgaccgaacgggccccacgtccggtccttcccccgtcggccgcccgtcgcctccgacggacgccacccgtccgacgacggcgacgacgccggcccgtcggggctcggccgtggtaccaaacggtaccttacgttcccggagttcgcgttcgtcgtgacggcgggcgtgggcaagggcgacgataagngn

SEQ ID NO: 397304 - DNA, 551 bp, Homo sapiens
  misc_feature: GZ8MTXP01B0WVN.3.39.D06.1.454.CMB.2.raw
  modified_base (196)..(196): a, c, t, g, unknown or other
  modified_base (227)..(227): a, c, t, g, unknown or other
  modified_base (264)..(264): a, c, t, g, unknown or other
  modified_base (418)..(418): a, c, t, g, unknown or other
  modified_base (434)..(434): a, c, t, g, unknown or other
  modified_base (518)..(518): a, c, t, g, unknown or other
  modified_base (543)..(543): a, c, t, g, unknown or other
  modified_base (551)..(551): a, c, t, g, unknown or other
tcagagacgcactccacgaccggtgctcgatttagtgacatctcgcagttctttgggttttggggggtccctgagactctcatgtacaggctctgagttcagcgtcactaaatactacatgagctgggtccgccaggctccgagggagggactggactgggtctccagtgttaacagcgatggaagtacatattangcagactcgtgaaggcattcacatctcaganacaatccaaagacactctagtatcttacaaatgaacngctgagagccgagacacgctttctatactgtgcgagcgatcgacgggcggtagtctagattacgtttcgtcggggaccaaggggacccttggtaccaccgttctcctcgacgccctaccgaacgaacgggccctacgtcgtcctccccgtgccnccctcgcctcgagacnccaccgtcgacgacggcacgacgccggccgtcggctcgccgtggtcgaaacggtccttaccgtccgagttcggccgttctcggngacgggcggacgtggacgaagggcngataaggn

SEQ ID NO: 397305 - DNA, 597 bp, Homo sapiens
  misc_feature: GZ8MTXP01CAFY2.3.39.D06.1.454.CMB.2.raw
  modified_base (551)..(551): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctttttcaaaggtgtccagtgtgaggtgcagatggtggagactgggaggaggcttgatccgaggcccggggggtccctgagactctcatgtacaggctctgagttcagcgtcaactaaatactacatgagcgtggggtcccgccaggcctaccgagggggagggggactggacgtgggtcctcgagtgttaaccaggcgagtaggaataacataattatgacagacgtcggaggaacgggccgtattaccacattccacaagacgaactaacttccaaagaacctacttctacgttaattacctacgaaatcgaaaccacgcctaggacgacggaccggtacggaccgtaacggtccctttagtacttacgtggtcgacggngcggtaactcgggaacggggcggtgttcgtcgttaacgtttccggg

SEQ ID NO: 397306 - DNA, 536 bp, Homo sapiens
  misc_feature: GZ8MTXP01EPR7Z.3.39.D06.1.454.CMB.2.raw
  modified_base (308)..(308): a, c, t, g, unknown or other
  modified_base (353)..(353): a, c, t, g, unknown or other
  modified_base (385)..(385): a, c, t, g, unknown or other
  modified_base (453)..(453): a, c, t, g, unknown or other
  modified_base (480)..(480): a, c, t, g, unknown or other
  modified_base (489)..(489): a, c, t, g, unknown or other
  modified_base (497)..(497): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctttttcaaaaggtgtccagtgtgaggtgcagatggtggagactgggaggaggcttgatccgaggccggggggtccctgagactctcatgtacaggctctgagttcagcgtcactaaatactacatgagctggggtccnccaggctccgaggggagggactggactgggtctcagtgttaaccngcgatggaagtaacataatatgcagactcggngaacgggcattcacatctaccagagaacaattccaaagaacactctaggtactcttacaaatgaaacngcctagacgagccgagcaacggtcttntaattacgngtgaccgngcgaatcgaacgggcggagttcctgttaactttaaccgg

SEQ ID NO: 397307 - DNA, 684 bp, Homo sapiens
  misc_feature: GZ8MTXP01CEO7U.3.39.D06.1.454.CMB.2.raw
  modified_base (315)..(315): a, c, t, g, unknown or other
  modified_base (518)..(518): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagcttgggttttccttgttgtctttttcaaaaggtgtccagtgtgaggtgcagatggtggagacgtgggaggaggcttgatccgaggcccggggggtcctgagactctcatgtacaggctcgtgagttcagcgtacaactaaatactacatgagcgtcgggtccncgaggctaccgaggggagggactggacgtgggtctccgagtagttaaccgagcgagtaggaagtaactaattaattatgacagtaccgtacggtaggaaacgggcctaattccaaccatcctaccgaagaacgaactaacgttaccaaaagtaacctacttacgttaggttaactttaccttaaacaaaacttcggaaaaccncggtacccgtaaggaacggtaaccggaccccggaaagggtacccgtaaacccgggttcccttttacgttaaacgtttccgtagggtcggaaccgggaggttacccggtaagtcccggggaacggggccggttaagttccgttaaggttaaccgtttttaaccgggg

SEQ ID NO: 397308 - DNA, 700 bp, Homo sapiens
  misc_feature: GZ8MTXP01A5TWZ.3.39.D06.1.454.CMB.2.raw
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagcttgggttttccttgttgtctttttcaaaaggtgtccagtgtgaggtgcagatggtggagacgtgggaggaggcttgatccgaggccggggggtcctgagactctcatgtacaggctcgtgagttcagcgtacaactaaatactacagtgacgtcgtcgggtccgccgaggcctaccggaggggagggactggacgtggtcctacgagtacgtaacgaggcgagtaggaagtaaacataagttatagacagtacgtccggtagaacggggtccctagttcccaaccgtattccctaaccgaaaggacgaactaaacgtaccaaaagacctacttcttacggtaacttcctttaaacaaagttaccgaaaacgtacgaccccgttaaggaacgaacccgggaccggtaaagggtaaccccggtaaccggtttcccctttaagttttaaaccgtttacggtacgggttacggacgggaaccgggttacggaaacgttccggggaacgggggttcgtaacggttcggttcgtttaacgttttaacccgggg

SEQ ID NO: 397309 - DNA, 738 bp, Homo sapiens
  misc_feature: GZ8MTXP01B7SMP.3.39.D06.1.454.CMB.2.raw
  modified_base (318)..(318): a, c, t, g, unknown or other
  modified_base (568)..(568): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagcttgggttttccttgttgtctttttcaaaaggtgtccagtgtgaggtgcagatggtggagacgtgggaggaggcttgatccgaggcccggggggtcctgagactctcatgtacaggtctctgagttcagcgtacaactaaatactacagtgagcgtcggggtcccncgaggccgtacggagggggacgggacgtgggacgtcggggtctaccgagttacgttaaaccgaggacgtagtagggaaataaacgtattaagttagtcgactaaggtaccgtaccgggtagggaaacggggtccctaattcccaacctacttcccgtaaccgaaaggtaacgaacctaaacgttacccaaaagtacctaaccttcttacgggttaaacttccgtttaaaccaaaagttacggaaaacccncggtaccctaaggggaacgaccggggtacccggaacgggtaacccgtaacccgggttcctttacgttaaacgttccggtttaggtcggaccggttaacgccgggttaacgaccgggtaaccggggggtacggtacgttaccttaacgggttaacgtttttaaccccgggg

SEQ ID NO: 397310 - DNA, 690 bp, Homo sapiens
  misc_feature: GZ8MTXP01CKFD7.3.39.D06.1.454.CMB.2.raw
  modified_base (472)..(472): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgtctttttcaaaaggtgtccagtgtgaggtgcagagtggtggagacgtggaggaggcttgatccgaggcccggggggtcctgagactctcatgtacaggtctctgagttcagcgtctaactaaatactacatgagcgtgggtcccgccgacggcctccggagggggacgggacgtggacgtcgggtcctccgagtagttaaacccgagacggagtaggaaagtaaactaattaattagtgacaaggtaccgtaccgtagggaaacgggtcccgtaattacccgacctatcctaccgaaacgganaaacctaaacgttacccaaaagaacctacttcgttaagttacttaaccgtttacaaaaagttcggaaacctacgacccgtaggaagaaacccgggccgaaacgggcccgtaacccgggttcccttttaaacgttacgtttaccgttggaccggttcgggttacgccggtaactccggggaacggggtcgtaccgttcgttaagttaacgttttcccgg

SEQ ID NO: 397311 - DNA, 672 bp, Homo sapiens
  misc_feature: GZ8MTXP01APTKB.3.39.D06.1.454.CMB.2.raw
  modified_base (373)..(373): a, c, t, g, unknown or other
  modified_base (402)..(402): a, c, t, g, unknown or other
tcagagacgcactccacgaccggtgctcgatttagtgacatctcgcagttctttgggttttggggagaggagcccagcactgggattccgaggtttttccattcggtgatcagcactgaacacagaggactcaccatggagttttggctgagcttgggttttccttgttgtctttttacaaaaggtgtccagtgtgaggtgcagatggtggagacgtggaggaggcttgatccgaggccggggggtcctgagactctcatcgtacaggctctgagttcagcgtacaactaaatactacatcgagcgtcgggtcccgcgaggccgtcggaggggacgggggtactgggacgtcgggtctacgaggtagtaacgngcggagtaggaaagtactaattattaagngacacgtaccgtcggtaggaaacgggtccctaacttccgaaccctagtccctaacgaacgaacaaacctaaacttacccgaaaagtacctacttacttgtaaacttacttaacggaaaactcggaaaactcgtacccgaggaacggtaccggtacccgggaacgtaccgtaccggttccctttaattaccgttaagttcggtacggcgaacgcggttacgtcggacgggggtcgacgttacgttggttaacgttcgttttaacccggggg

SEQ ID NO: 397312 - DNA, 621 bp, Homo sapiens
  misc_feature: GZ8MTXP01DQHP5.3.39.D06.1.454.CMB.2.raw
  modified_base (517)..(517): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgtctttttcaaaggtgtccagtgtgaggtgcagatggtggagactgggaggaggcttgatccgaggccggggggtccctgagactctcatgtacaggctctgagttcagcgtcaactaaatactacatgagcgtcggggtcccgcgacggctaccgagggggaggggtactgggacgtgggttcctccgagtcgttaaaccaggtacgtagtaggaagtaaacattaattatgacacgacgtcgtaggaagggtccctattccaccattcctacgaaggactaactaacttacccgaaaagacctaacttccgttagttaactttacttaaaccaaaagttcgaaaacncgtaccgtaaggacgacgacccggaacgaaccgaaccgttcttacttacgttcgtcggcgacggcgacgtgacggaacggggtgtacgttctaagttcgtttcg

SEQ ID NO: 397313 - DNA, 585 bp, Homo sapiens
  misc_feature: GZ8MTXP01CTV3H.3.39.D06.1.454.CMB.2.raw
  modified_base (197)..(197): a, c, t, g, unknown or other
  modified_base (224)..(224): a, c, t, g, unknown or other
  modified_base (230)..(230): a, c, t, g, unknown or other
  modified_base (247)..(247): a, c, t, g, unknown or other
  modified_base (255)..(255): a, c, t, g, unknown or other
  modified_base (289)..(289): a, c, t, g, unknown or other
  modified_base (296)..(296): a, c, t, g, unknown or other
  modified_base (577)..(577): a, c, t, g, unknown or other
  modified_base (583)..(583): a, c, t, g, unknown or other
  modified_base (585)..(585): a, c, t, g, unknown or other
tcagagacgcactccacgaccggtgctcgatttagtgacatctcgcagttctttgggttttggggggtccctgagactctcatgtacaggctctgagttcagcgtcactaaatactacatgagctgggtccgccaggctccgagggaggggactggactgggtctccagtgttaacagcgatggaagtacatattangcagactcgtgaagggcattcacatcnccaganacaatcaagacactctntatcttanaaatgaacagctgagagcgagacacggtcctttntattacngtgcgagcgatcggacgggcggtatctgactttacgttttccggtcgggggaccaggggtaacccctggtaccacccgtctccctcacgccctaccaaccgacgggcccagtccgtcccttccccgcggccgtcccgtcgcctaccgacggacgccaccgtacgacgacgggaccaaccgacggccggtcccgtcgggcgtcgacccgtggtaccgaacgtaccttacgtccggaggttcgtcgttcgtcggtgacggcgggttcgtgggacgaacggcgnagtcgngn

SEQ ID NO: 397314 - DNA, 734 bp, Homo sapiens
  misc_feature: GZ8MTXP01B8R68.3.39.D06.1.454.CMB.2.raw
  modified_base (386)..(386): a, c, t, g, unknown or other
  modified_base (538)..(538): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggtagttttggctgagtcttgggttttccttgttgtctttttacaaaggtgtccagtgtggaggtgcagagtggtggagacgtgggaggaggtcttgacgtccgagggcccggggggtcctgacgactctcagtgtacaggtctcgtgagttcagcgtacaactaaatactacatgacgcgtcggggtcccgcgaggcctacggagggggacgggactggacgtgggtctaccgagtacggttaaaccnggacgtagtagggtaaactaagaattaattagtcgacagtaccgtccgggtaaggaacggggtccctaatcccgaactactccctaccgaaaggacctaaactaaacttacccgaaaagtacctacgttacttaaggtacttaacctttaanaaaacgttcggaaacctcgtccgtaagggaaacgtacccgggaccggaaacggtaacccgtaacccggttccttttacgttaaacgttacccggtgggttacggaccgggttacggacccgttaacgggtcccgggaaccggggggaccggttaggttaccccgttaagggttaacccgttttttaaccccggggg

SEQ ID NO: 397315 - DNA, 708 bp, Homo sapiens
  misc_feature: GZ8MTXP01CFBT3.3.39.D06.1.454.CMB.2.raw
  modified_base (639)..(639): a, c, t, g, unknown or other
tcagagacgcactccacgaccggtgctcgatttagtgacatctcgcagttctttggggttttggggagaggagcccagcactgggattccgaggtgtttccattcggtgatcagcactgaacacagaggactcaccatggtagttttggctgagtcgttgggttttccttgttgtctttttacaaaggtgtcagtgtgaggtgcagagtgggtggagacgtgggagggaggtcttagacgtccggacggggcccgggggggtccctaggacgactctcgatcggtacgaggtctcgtgtacgtcgagtcgtactaactaaatactaacagtagacggtcggtacgggtcccgaccgacgggccgtaccgggagggggacgggtacggtcgggtcggtcgggtctacgtagttacgtaaaccgagacgtaagtaggaagttaaactattaatagtagtaccgacggtaccgtacgggtaggaacgggtcctaccttacgaacctactccgaccgaagtaacgaacttaaacctaccgaaaacactactagttacgtaacttactaacgaatacgaactacgtcgtaagacggacggaccggacgtaaccgtcggttaaccttgttaacgttcgtcggtancggttacgacggttaacgccgggtaacggggtcggtacgttacgtaaccggttcgttttaacccggggg

SEQ ID NO: 397316 - DNA, 565 bp, Homo sapiens
  misc_feature: GZ8MTXP02G1RGK.3.39.D06.1.454.CMB.2.raw
  modified_base (366)..(366): a, c, t, g, unknown or other
  modified_base (403)..(403): a, c, t, g, unknown or other
  modified_base (434)..(434): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactggtccgccaggctccgaggggaaggggctgggagtgggtctcgagttattacaattcgtggtaccacntacctactcccgaccccgtgaacgggcctataaaccntcctccagagacgatccgaagaaccagggtntactacttacaaaatcgaaacaacctgaacgacgccgaacgacgacggtaccgtttatacgtgtagcgagacgtattcggagtcggttccgggacctcgacccttggttacctacgtttcacgtcttcggg

SEQ ID NO: 397317 - DNA, 531 bp, Homo sapiens
  misc_feature: GZ8MTXP02H8SY1.3.39.D06.1.454.CMB.2.raw
  modified_base (303)..(303): a, c, t, g, unknown or other
  modified_base (425)..(425): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttcctgttgcttttcaaaaggtgtccagtgtgaggtgcagatggtggagactggaggaggcttgatccaggccggggggtccctgagactctcatgtacaggctctgagttcagcgtcactaaatactacatgagctgggtccncaggctccgaggggaggggactggactgggtctccgagtgttaacagcgatggaagtacatattatgacagactccggtagaacgggccgatcaccatcctccaagagacaatccaagaacnctctgtatcttacaaatgaaacagcctagagagcccgaggaccacggtcctttactacttactgtgccgagcgtaagtcgaacgggcggagtctaggtactttacg

SEQ ID NO: 397318 - DNA, 572 bp, Homo sapiens
  misc_feature: GZ8MTXP02G1BPE.3.39.D06.1.454.CMB.2.raw
  modified_base (226)..(226): a, c, t, g, unknown or other
  modified_base (246)..(246): a, c, t, g, unknown or other
  modified_base (315)..(315): a, c, t, g, unknown or other
  modified_base (352)..(352): a, c, t, g, unknown or other
tcagagacgcactccacgaccggtgctcgatttagtgacatctcgcagttctttgggttttgggggtccctgagactctcatgtacaggctctgagttcagcgtcactaaatactacatgagctgggtccgccaggctccgagggagggactggactgggtctccagtgttaacagcgatggaatacatattatgcagactcgtgaaggccattcacatctcaganacaattccaagaacacggtntctctgacaagtgaaatgcctgagacgtgacgacacggctgtgtattactgtgcgagagtagggtttcncaggctcggtccggcggccccagttgaacatgactancactacgtacggtctgggacgtcgtgggtacgaagggacccaggtcatccgtctccgtcacgcctaccaaccgacgggccctagtccgtcctccccgtgcccaccctccaccaagtacgccaccgtcgtacggggccacgacggcccggccgtcggggtcctccggtcccgtaggtaaccgaaacgggtacccttacgtaccgtacgtcggtacgttccg

SEQ ID NO: 397319 - DNA, 549 bp, Homo sapiens
  misc_feature: GZ8MTXP02G359S.3.39.D06.1.454.CMB.2.raw
  modified_base (419)..(419): a, c, t, g, unknown or other
  modified_base (437)..(437): a, c, t, g, unknown or other
  modified_base (516)..(516): a, c, t, g, unknown or other
  modified_base (532)..(532): a, c, t, g, unknown or other
  modified_base (548)..(549): a, c, t, g, unknown or other
tcagagacgcactccacgaccggtgctcgatttagtgacatctcgcagttctttgggttttgggggtccctgagactctcatgtacaggctctgagttcagcgtcactaaatactacatgagctgggtccgccaggctccagggagggactggactgggtctccagtgttaacagcgatggaagtacatattatgcagactccgtgaagggccgattcaccatctccagagacaattccaagaacactctgtatcttcaaatgaacagcctgagagccgaggacacggcctttctattactgtgcgagcgatcgacggggcggagtctgattactttcgtggggccagggaccctggtccaccgtctcctcacgcctccaccgaacgggcccagtccggtcccttcccccgtgggcccnccctgccctccagggacnccacctccggagacgccacgacggccgggcccgtggggcctcggccctggtaccaaggtctacgttccgagtcgcgtcncgtcggacgcgggtcnggcaacggcgcatagnn

SEQ ID NO: 397320 - DNA, 560 bp, Homo sapiens
  misc_feature: GZ8MTXP02GM66Q.3.39.D06.1.454.CMB.2.raw
  modified_base (356)..(356): a, c, t, g, unknown or other
  modified_base (417)..(417): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctttttcaaaaggtgtccagtgtgaggtgcagatggtggagactgggaggaggcttgatccgaggccgggggggtccctgagactctcatgtacaggctctgagttcagcgtcaactaaatactacatgagctgggtccgcaggctccgaggggaggggactggacgtgggtctccgagtgtaaccngcgatggaagtacaatattatgacagactccgtagaacggggcagttcacatctaccaganacaattaccaaagaacactctagttatactacaaatgaaacacgctaggaacgacgaccggaggaccacggtaccttacgttacttacgtcgtcggccgaggccgaagtccggacggggccgagtccgtagtacgtttaccgg

SEQ ID NO: 397321 - DNA, 495 bp, Homo sapiens
  misc_feature: GZ8MTXP02JG62P.3.39.D06.1.454.CMB.2.raw
  modified_base (295)..(295): a, c, t, g, unknown or other
  modified_base (366)..(366): a, c, t, g, unknown or other
  modified_base (397)..(397): a, c, t, g, unknown or other
  modified_base (401)..(401): a, c, t, g, unknown or other
  modified_base (407)..(407): a, c, t, g, unknown or other
  modified_base (412)..(412): a, c, t, g, unknown or other
  modified_base (414)..(414): a, c, t, g, unknown or other
  modified_base (418)..(418): a, c, t, g, unknown or other
  modified_base (421)..(421): a, c, t, g, unknown or other
  modified_base (425)..(425): a, c, t, g, unknown or other
  modified_base (436)..(436): a, c, t, g, unknown or other
  modified_base (459)..(459): a, c, t, g, unknown or other
  modified_base (472)..(472): a, c, t, g, unknown or other
  modified_base (494)..(495): a, c, t, g, unknown or other
tcagagacgcactccacgaccggtgctcgatttagtgacatctcgcagttctttgggttttggggggtccctgagactctcatgtacaggctctgagttcagcgtcactaaatactacatgagctgggtccgccaggctccagggaggggactggactgggtctccagtgttaacagcgatggaagtacatattatgcagactccgtgaagggccattcaccatctcagagacaattccaagaacactctgtatcttacaaatgaacagcctgagagccgaggacacggcctttntattactgtgcgagcgatcgacggggcgagtctgattactttcgtggggccaggacctggccacgtctccncagccctcaccgaggcccatccgtcctcccngccncctgcncagcncnctcngcncacngccgcctggcngccgtgcagctacgtcagtgctntctcgacggcggngtcggacaaggcgacacgtagnn

SEQ ID NO: 397322 - DNA, 756 bp, Homo sapiens
  misc_feature: GZ8MTXP02I9UW1.3.39.D06.1.454.CMB.2.raw
  modified_base (502)..(502): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagacctctcgtgtcgcgacgtcctcgtcggtccttaccgtaccgtacgtaggtacgaccgacgtacctaactagtcgaccgtacgggtccgggtccccgaccggacggtccgtaccggggaagggggaacggggtcggtagggtaggggttcggtactacgttaacgttttacgttaactaacgtttccggtacggtaaccactacttacctacccgtacccgtacccgtagggaaccgggacctaacgtaaacccnttacccgacgaaggacgaacgttacgtcccggaaaagtaacccggtgggtttaactactttaccgtaaaactaaagtaacccggaaacctaccggtaggaaaccgacccgaaccggaaccgaaccggtaaccgggtttaccttttaagtacggtgtacgggacgtaaggaaacgttacgtacggtaggggttccggggtacccggtacctcccggttacgttcggttaccttacgtcgtacgttcggtccgggg

SEQ ID NO: 397323 - DNA, 596 bp, Homo sapiens
  misc_feature: GZ8MTXP02GCHMU.3.39.D06.1.454.CMB.2.raw
  modified_base (481)..(481): a, c, t, g, unknown or other
  modified_base (529)..(529): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgcttttcaaaaggtgtccagtgtgaggtgcagatggtggagactggaggaggcttgatccgaggccggggggtcctgagactctcatgtacaggctctgagttcagcgtacaactaaatactacatgagctgggtccgcgaggcctccggaggggacggggactgggacgtcggggtcctcgaggttcgtaaccgagcgagtaggaagtacattattatgactagactccggtaggaacggggcctattacccactatccgtacaagacgactaactaccaaagacactctagtacttctaacaaatgaaacnggcctagacgacgaccggagacctacggtaccctttataacgttacgngggttcgacggacgtaccggtaactccggggaacgggggtcgtacgtctacggtaacttttaccggg

SEQ ID NO: 397324 - DNA, 894 bp, Homo sapiens
  misc_feature: GZ8MTXP02HY32O.3.39.D06.1.454.CMB.2.raw
  modified_base (282)..(282): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctatttcaaaaggtgtccagtgtgaggtgcagggtggtggagacgtggaggaggcttgatccagccgtgggggtcctgagactctcctgtgcacgcctctggcttcgaccgtnagtagcagctacatcgcctacgtcggggtccccgaccgaacgggtcctacccggaaagggggtaacggggggtccgttagggggaacgggtttcgggggtacctttaaccggttaaacggggtttttaaactttttaaacccgtaaaagtttcccggtttaacgggttaaaccccctaacttaaccgtttaaccccgtaacccgttacccccccgggtaaacccccccggggttaagggtaaaaccgggggaacccccttaaaacgttaaacccccgtaacttaccccgtaacccgaaacggacggtaaacccggttaacttaaccccgggaagtaaaacccgtacggggttataacttaaccgtttaaccaaaagtttacggtaaaaccaaacccggttagaacgggaacccgaccccggtaaacgtaaacccggtccggtttaaaccggtttttaaaccgttaccgtaggttacggacccggggttaaagtaacggttaaacggttccgggttaaacggggttccgggggtttttaaacccggggcccctttaaccggtacccccgttgggtttaccctaccgtttaacgcgttttaccccgtccggggg

SEQ ID NO: 397325 - DNA, 614 bp, Homo sapiens
  misc_feature: GZ8MTXP02JDHJS.3.39.D06.1.454.CMB.2.raw
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgtctttttcaaaaggtgtccagtgtgaggtgcagatggtggagactgggaggaggcttgatccgaggccggggggtccctggagactctcatgtacaggctctgagttcagcgtcaactaaatactacatgagctgggtcccgcgacggcctaccgaggggaggggactgggacgtgggtctccagtgttaacagcgagtaggaagtacatatatgacagactccggtagaacgggcccattcgacccattcacccgaagacgaacctaaagttcccaaaagacctaactctagtactacttacaaaagttgaaacacgtcccgtaagaacggacgaacccggagaacccgacgggtccctttatacgttaacgtcgttcggacgtaacgccgtaacgttaaccggacgggggtacccgtagtccgttacggtaacttttaccggg

SEQ ID NO: 397326 - DNA, 558 bp, Homo sapiens
  misc_feature: GZ8MTXP02FUYON.3.39.D06.1.454.CMB.2.raw
  modified_base (361)..(361): a, c, t, g, unknown or other
  modified_base (393)..(393): a, c, t, g, unknown or other
  modified_base (450)..(450): a, c, t, g, unknown or other
  modified_base (480)..(480): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagcctgggggtccctgagactctcctgtgcagcctctggcttcaccgtcagtagcagctacatgcactgggtcccgcaggctccgaggggagggctggagtgggtctcagttatttacaattctggtaccantactactccgaccccgtgaacggcattaaccntactcagagacgattccgagaacacggtagtatcttacaaatcgaacaacctggaanacgaccgacgacacggtaccgttattacgngtcgacgtagagtagttcgagttcggtaccggggacctccgtacccgtggtttacctacgttcgacgttccttacggg

SEQ ID NO: 397327 - DNA, 675 bp, Homo sapiens
  misc_feature: GZ8MTXP02I21JN.3.39.D06.1.454.CMB.2.raw
  modified_base (195)..(195): a, c, t, g, unknown or other
  modified_base (222)..(222): a, c, t, g, unknown or other
  modified_base (227)..(227): a, c, t, g, unknown or other
  modified_base (239)..(239): a, c, t, g, unknown or other
  modified_base (300)..(300): a, c, t, g, unknown or other
  modified_base (308)..(308): a, c, t, g, unknown or other
  modified_base (321)..(321): a, c, t, g, unknown or other
  modified_base (384)..(384): a, c, t, g, unknown or other
  modified_base (672)..(672): a, c, t, g, unknown or other
tcagagacgcactccacgaccggtgctcgatttagtgacatctcgcagttctttgggttttgggggtccctgagactctcatgtacaggctctgagttcagcgtcactaaatactacatgagctgggtccgccaggctccgagggagggactggactgggtctccagtgttaacagcgatggaagtacatattangcagactcgtgaaggccattcacatcncaganacaatcaagacnctctgtatcttacaaatgaacagtccagacgagaccgaaggacacggcctttatattacgngtgcgagngactacgacgggngatcgtgtaagttcgtttcggtcggggaccaacggggacccttgggtaccacccggttctccncgaacgtccctacccgaacgaaacgggtcccctacgtcccggtcccttccccgcggcccgtccccgttacgcccgtaccgaacgggtcgacccaacccgtacggaacgacgacccgtacggccggtcccgggtacccgcgggtccgtccggtcccgtagggttaaccgaaaccggggttaccttaaccggttaccggacggttccggtccgttaacggttacggtcgggtaaccgggccggggttaccgtcggggaacccggaacgggtcccggaagtaacggtacgngcg

SEQ ID NO: 397328 - DNA, 659 bp, Homo sapiens
  misc_feature: GZ8MTXP02IYSQ5.3.39.D06.1.454.CMB.2.raw
  modified_base (266)..(266): a, c, t, g, unknown or other
  modified_base (282)..(282): a, c, t, g, unknown or other
  modified_base (306)..(306): a, c, t, g, unknown or other
  modified_base (326)..(326): a, c, t, g, unknown or other
  modified_base (523)..(523): a, c, t, g, unknown or other
tcagagacgcactccacgaccggtgctcgatttagtgacatctcgcagttctttgggttttggggagaggagcccagcactgggattccgaggtgtttccattcggtgatcagcactgaacacagaggactcaccatggagttttggctgagctgggttttccttgttgtctttttacaaaaaggtgtccagtgtggaggtgcagagtggtggagacgtgggaggaggtcttgactccgagggccggggggtccctgacgactctnatgtacgaggctctgngttcagcgtacaactaaatactanatgacgtcgtcggggtcccnccgacggccgtaccggaggggacggggtacgtagggtacgtcgggtacctccgtaggttacggttaaccgacggtacgtagtaacgggtaataacgttattacgtttagcgacgtacgtaccgtacgggtaagggaacggtccgtaattaccgacctacgtacctacgaaagaccgtaaataaactaacccgaaaanacctacttcgttaatacttactaactaagacgaacgacgacgtagaacggcggaacggacgtaccgtccgttacttagtacgttacgtcgcgacgtgacaacggtcggacggtcgtcgtacgtacgtacgtttcgg

SEQ ID NO: 397329 - DNA, 508 bp, Homo sapiens
  misc_feature: GZ8MTXP01EKYED.44.71.G05.1.454.CMB.2.raw
  modified_base (302)..(302): a, c, t, g, unknown or other
  modified_base (362)..(362): a, c, t, g, unknown or other
  modified_base (423)..(423): a, c, t, g, unknown or other
  modified_base (455)..(455): a, c, t, g, unknown or other
  modified_base (504)..(504): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaaccaacagtgacgtcggtcgttttgaccgtgtctctggtaccagcagaccccagaaacagcccccaaatcattattangcgtcaatgttcgccctttcgtgtccctgagcgcttcctctgggtccaagtctggcaacncggcctccctgaccatctctgggctccaggctgaggacgaggctgattatactgcaggctnacatacaagtggaactactttactattcggcnaagggaccagcttgaccgtcaggttcagcccaagctcgccccttggtcncgtc

SEQ ID NO: 397330 - DNA, 607 bp, Homo sapiens
  misc_feature: GZ8MTXP01DR6N8.44.71.G05.1.454.CMB.2.raw
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaaccaacagtgacgtcggtcgttttgaccgtgtctcctggtaccagcacgaccccaagaaacacgacccccaaatcaattattatgcgtacaatcgttcgccccttcggtcgtccctgacgcgtctttccctctggggtcccaagtcctagggacaaccgacgggccctccctagacccatctcgtggctccgaggctgaggacgaggctgattattactgcaggctcatatacaagtggaaactactttactaacgttccgggcgacgaacggggacccaaaggtccgttacggaaaccccggttaccttaacggggttcccaacggcccccgaaaagggtcccttcccggcccccccgttcgggttcccaaccgtttccccg

SEQ ID NO: 397331 - DNA, 529 bp, Homo sapiens
  misc_feature: GZ8MTXP01ENYSV.44.71.G05.1.454.CMB.2.raw
  modified_base (233)..(233): a, c, t, g, unknown or other
  modified_base (284)..(284): a, c, t, g, unknown or other
  modified_base (305)..(305): a, c, t, g, unknown or other
  modified_base (310)..(310): a, c, t, g, unknown or other
  modified_base (328)..(328): a, c, t, g, unknown or other
tcagacagtatatacacgaccggtgctcgatttagtgtcgtcgcaagagagaggagggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaccaanagtgacgtcggtcgtttgaccgtgtctctggaccagcagaccccagaaacncgacccccaaatcattattangcgtnaatgtccgcccttcggtntccctgacgcgtccttctcgtgggtccaagtctggcaaacacggccctcctgaccatctctggctccgagctgaggacgaggctgattatactgcagctacatatacaagtggaaactactttactattcggcgaacgagggaaccaagcgtcgaccgttcgttaggttcaagcccaaggcctcgcccctcggttctaacc

SEQ ID NO: 397332 - DNA, 564 bp, Homo sapiens
  misc_feature: GZ8MTXP01CXSAI.44.71.G05.1.454.CMB.2.raw
  modified_base (305)..(305): a, c, t, g, unknown or other
  modified_base (317)..(317): a, c, t, g, unknown or other
  modified_base (477)..(477): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctcctgcactggaaaccaacagtgacgtcggtcgttttgaccgtgtctctggtaccagcacgaccccagaaaccacgacccccaaatcattattangcgtcaatgtcnccctttcggctccctgagcgtcttcctcgtgggtccaagtctaggcaacgaccggccctcccgtgaccctatctcgtcgggctccgaggctggaggacgaggctgattatactgcaggctacatagtaacaaggtggaaactactttactgttcggccgngaacgggaccaaggtccttacggtaacccgtcgttaaggttccacgccccgaaggtcctccggcccccttcggtccaacgtttcccg

SEQ ID NO: 397333 - DNA, 524 bp, Homo sapiens
  misc_feature: GZ8MTXP01AJPOC.44.71.G05.1.454.CMB.2.raw
  modified_base (518)..(518): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacacgcccccaaactcattatttatgcggtcaatgttcgccctttcggtgtccctgagcgcttcctctgggtccaagtctggcaacacggccctccctgaccatctctgggctccgaggctgaggacgaggctgattatactgcaggctcatatacaagtggaactactttactattcggcgcgaagggaccaaggccttgaccgtcttaggttcacgcccaggctcgccccttggtcncgtccg

SEQ ID NO: 397334 - DNA, 550 bp, Homo sapiens
  misc_feature: GZ8MTXP01BLN1T.44.71.G05.1.454.CMB.2.raw
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcttttgacgtgtctctggtaccagcagaccccagaaacacgacccccaaatcattatttatgcgtcaatgttcgccctttcggtgtccctgacgcgcttcctctggggtccaagtctgggcaacgacggcctccctgaccatctctgggctccaggctgagacgagctgattatactgcaggctcatatacaagtggaactactttactagtttcggcgcgaacggggtaccaaaggcttcggaacccgttcgacgggttcacggcccaaagggccttaccggcccccgttcgggtccttaacttcccg

SEQ ID NO: 397335 - DNA, 524 bp, Homo sapiens
  misc_feature: GZ8MTXP01BJUAN.44.71.G05.1.454.CMB.2.raw
  modified_base (360)..(360): a, c, t, g, unknown or other
  modified_base (518)..(518): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctctggtaccagcagaccccagaaacacgccccaaactcattattatgcgtcaatgttcgccctttcggtgtccctgagcgcttctctggtccaagtctggcaacncggccctcctgaccatctctgggctccgaggctgaggacgaggctgattatactgcaggctcatatacgaagtgggaactacttttactagttccggcgcgaagggaccaagcgttcgaccgtcttaggttcacgcccaggcctcgccccttcggtcncttccg

SEQ ID NO: 397336 - DNA, 551 bp, Homo sapiens
  misc_feature: GZ8MTXP01CN65K.44.71.G05.1.454.CMB.2.raw
  modified_base (304)..(304): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcttttgaccgtgtctcctggtaccagcagaccccagaaacacgacccccaaatcattatttangcgtacaatgttcgccctttcggtcgtccctgacgcgtctttccctctgggtccaagtctacgggcaacgacggccctccctgacccatctctcgggctccaggctggaggacgagctgattatactgcaggctcatatacaagtggaaactactttactagttcggcgcaacggggaccaaggtccttcggaaccgtccgttaagggcacgcccaaggcctacgccccttcggtccaacgttcccg

SEQ ID NO: 397337 - DNA, 568 bp, Homo sapiens
  misc_feature: GZ8MTXP01ANJUA.44.71.G05.1.454.CMB.2.raw
  modified_base (383)..(383): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggctgttttaaaggtgtccagtgtgaagtgcagctgttggagtcggggggagcttggtacaggccgggggggtccctgacactctcctgtgcagcctctggattcgcctttaatacctatgccatgatctggggtcctcaggccccagggaaggggctggagtgggtctcatccattactggtggtagtgccacaaatgtcgcagactccggtgaagggccgcttcatccgtctcagggacaattcccaaagaatacggtntttctgcagatgaagagcctgcgagtggacgacacggtccctttatacctgtcgccgaggggagggtcgacgaagaaagttaacaaactaaataacaagtattaactactacaatggacgtcgttggggacaaacggggccccgttcaccgtctccctcacgcccttaccaaccgaacgggcccc

SEQ ID NO: 397338 - DNA, 591 bp, Homo sapiens
  misc_feature: GZ8MTXP01BM07X.44.71.G05.1.454.CMB.2.raw
  modified_base (347)..(347): a, c, t, g, unknown or other
  modified_base (361)..(361): a, c, t, g, unknown or other
  modified_base (390)..(390): a, c, t, g, unknown or other
  modified_base (495)..(495): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcgggaggtcgggggggggcttggcacaggccagggcggtctctgagactctcctgtgtagtctcaggtattcagttcttagtgattatcactggcctgggtcctcaggctcgagggagggcttgagtggatctactttcgcagaatggaaacgttnggtagaagtaaagngtacgccgtacgtctaggtagaagggganacttcaaccgtctacgaagggtactagactaccaacagttagttggacctattacaatgagacaacgtgaacggaacccgacgaccacgaggcgtactattacgngtccgaccgacggcgaactccgttgggacgttcgatcggttacttgtttgaattaggtttcggggaccgtagggggaactaaggttcggtaacccg

SEQ ID NO: 397339 - DNA, 639 bp, Homo sapiens
  misc_feature: GZ8MTXP01D99OC.44.71.G05.1.454.CMB.2.raw
  modified_base (550)..(550): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgagggcgactgggcgggaggtcgggggggggcttggcacgagccgaggggcggtctctgagactctcctgtgtagtctcaggtattcagttcttagtgattatctacgtggcctgggtccgtcgaggcctccgaggggagggtcttggagtggatcgtacgtttcgcaagtaagtaggtaaaacgtttgtagggtaggaaaagtaaaaggaggtaacgccggtacgttcgtagggtagggaaggggaataacgttccgaaccggttctacgaaaggggtatacgactaccaacgtagttgtcggtacctaatttaacaaagtgacgacaaacgtcgaacggacccgacgaacacgacggcgtactaattacncgccgaccgacggcgaatcccgttggggacttcggagttgcgttgtttgaattagtttcggggaccgaggggactaagttcggtaaccg

SEQ ID NO: 397340 - DNA, 717 bp, Homo sapiens
  misc_feature: GZ8MTXP01ADZ6W.44.71.G05.1.454.CMB.2.raw
  modified_base (297)..(297): a, c, t, g, unknown or other
  modified_base (347)..(347): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgaggggcgactgggcggaggtcgggggggggcttgggcacagccaggggcggtctctgagactctcctgtgtagtctcaggtattcagtcttagtgattatcactggcctgggtccgtnaggctccgagggagggcttgagtggatcactttcgcagaatgaaacgttntggtaggaaagtaaagagtacgccgacgtcgtagtaggaaggggagattcaaccgtctacgaaagggggtactacggaacttacccaaacgtaggttacgttacgggacccctaaagtttttaaaccaaaagttgaaacggacctaaacccgttaggaaccgggaaccccggaacggaaccaaaccgaacgggggtcccgttacgtaactttaaccgtggtcccgacccgaacggggccgtaacgtcccggttagggggaacccgttaccggggaaacttgggcccttaaggttttacggaacgtttagggttttcggggggaccccgaaggggggggttaaccctaaagggttccgggggttaaccccg

SEQ ID NO: 397341 - DNA, 584 bp, Homo sapiens
  misc_feature: GZ8MTXP01B7VK9.44.71.G05.1.454.CMB.2.raw
  modified_base (230)..(230): a, c, t, g, unknown or other
  modified_base (304)..(304): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacngtgacgtcggtcgtttgaccgtgtctctggtaccagcacgaccccagaaaccacgacccccaaatcattattangcgtacaatcgttcgcccttcggtgtccctgagcgtcttcctcgtgggtaccaagtctaggaccaacgcggccctccctgacccatctcgtcgggctccgaggctggacggtacgaggctagtacttatactgcaggctacatataacaagtcggaaacttactttactacgttcggcgtcgaacggggaaccaaggtccttacggtacccgttcttaacgggttccaacggccccaagggtccctaccggcccccttcgggtcccttaacctttccccg

SEQ ID NO: 397342 - DNA, 614 bp, Homo sapiens
  misc_feature: GZ8MTXP01C6GQI.44.71.G05.1.454.CMB.2.raw
  modified_base (310)..(310): a, c, t, g, unknown or other
  modified_base (327)..(327): a, c, t, g, unknown or other
  modified_base (339)..(339): a, c, t, g, unknown or other
  modified_base (353)..(353): a, c, t, g, unknown or other
  modified_base (488)..(488): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagttggctaatcttgtattttcttgttagtttttagaggtgtccagtgcggagggcgacgtgggcggaggtcgggggggggcttgggcacgagccgaggggcggtctctgagactctcctgtgtagtctcaggattcagttcttagtgattatcactggcctgggtcctcaggctcgagggagggnttgagtggatcattcgnagaatgaaattnggtagaagtaaagngtacgcgcgtctagtaggaagggaatattaccgaccgtctacgaaaggggatacgacctaccaaacgtgttgttacggacctaatttaacaaatgagacaactgacgacccgagacacgaggctacgatttacgngccgtccgaaggcgaacgtcccgttgggggacccgttggaacttgggaaccttgttttaggaacgtttaagggttttcggggggaccccgaaggggggttactaaacggtttcgggggtaaccccg

SEQ ID NO: 397343 - DNA, 630 bp, Homo sapiens
  misc_feature: GZ8MTXP01EP4Z3.44.71.G05.1.454.CMB.2.raw
  modified_base (459)..(459): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggttcgtttgaccgtgtctcctggtaccagcacgaccccaagaaaccacgacccccaaatcattattatgcgtcaatgttccgccctttcggtcgtccctgacgcgtcttcctcgtcggtccaagtctacggacaacgaccggccctccctgaccctatctcgtcgggcctccgaggctaggaggacgaggtctagtattactactgctagggctacattanacgaaggtacgggtaaactacgtttaacgtacgttccgggaccgcgaacggggtaacccaacggtccgttacggtaaccccggttccgttaacggggttcccaaccgggcccccgaaaggggtccccttcccgggccccccgttcgggttaacccttaacccgtttccccg

SEQ ID NO: 397344 - DNA, 647 bp, Homo sapiens
  misc_feature: GZ8MTXP01AYZP1.44.71.G05.1.454.CMB.2.raw
  modified_base (425)..(425): a, c, t, g, unknown or other
tcagacagtatatacacgaccggtgctcgatttagtgtcgtcgcaagagagaggggcccagccctggggactgaacagagagaactcaccatggagtttgggctgagctggctttttcttgtggctgttttaaaaggtgtccagtgtgaagtgcagctgttggagtcggggggaggcttggtacaggccggggggtccctgacactctcctgtgcagcctctggattcgcctttaatacctatgccatgatctgggtccgtcacggccccaggggaaggggctgggagtgggtctcagtccattactgggtggtagtggaccaactaaatcgtacgcagacctccggtagaacgggggcctcttcatccgtccctaccgaggggacctaattcccaaaaggtaaattaaccgggttgttttaccngtacagtatggaaagacgccctaggcgaggtgacgtacgaccggttccctttagtacctgtcgaccgaggacgggggtcgacaagtaaacgttaacaaacaaatactaaagttattaactactacagtggaacgttcggacgggggaccgaaacggggcccccgttacgcccggttactccctcgaacggcccctaccgaacccgaacgggcccctaaccgg

SEQ ID NO: 397345 - DNA, 574 bp, Homo sapiens
  misc_feature: GZ8MTXP01BYZC0.44.71.G05.1.454.CMB.2.raw
  modified_base (229)..(229): a, c, t, g, unknown or other
  modified_base (489)..(489): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccanagtgacgtcggtcgtttgaccgtgtctctggtaccagcacgaccccagaaaccacgacccccaaatcattatttatgcgtacaattcgttccgccctttcggtcgtcccctgacgcgtcttcctcgtgggtccaagtctaggcaacgccggccctccctgaccatctcgtcgggctccgagctggaggacgaggctagattactactgcaggctacaatacgtaacgaaggtacggaaactactttacgtacttcgggcncgaagggacccaagtccttcgtaacccgtcgttaagggttccaacggcccaaggcctccgccccttacggtccttaacgttcccg

SEQ ID NO: 397346 - DNA, 541 bp, Homo sapiens
  misc_feature: GZ8MTXP01CI0DA.44.71.G05.1.454.CMB.2.raw
  modified_base (339)..(339): a, c, t, g, unknown or other
  modified_base (354)..(354): a, c, t, g, unknown or other
  modified_base (362)..(362): a, c, t, g, unknown or other
  modified_base (376)..(376): a, c, t, g, unknown or other
  modified_base (386)..(386): a, c, t, g, unknown or other
  modified_base (394)..(394): a, c, t, g, unknown or other
  modified_base (485)..(485): a, c, t, g, unknown or other
  modified_base (502)..(502): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcggagtcggggggggcttgggcacagccagggcggtctctgagactctcctgtgtagtctcaggattcagtcttagtgattatcactggcctgggtcctcaggctccgagggagggcttgagtggatcactttcgcagaatgaaacgttntggtggaagtaaagngtacgcgngtctgtgaaggganattcaccgtntcaagggntgactcaacagtgttggacctatttacaaatgagacaacctgacggacccgacgaccacaggcgtcgtattactgcgccaggcgaatccgngggacgttcgatgcttntttgaattagttggggccaggggactaagttggtaaccg

SEQ ID NO: 397347 - DNA, 700 bp, Homo sapiens
  misc_feature: GZ8MTXP01EU0UQ.44.71.G05.1.454.CMB.2.raw
  modified_base (342)..(342): a, c, t, g, unknown or other
  modified_base (367)..(367): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacagccagggcggtctctgagactctcctgtgtagtctcaggattcagttcttagtgattatcactggcctgggtcctcaggctccgagggaggcttgagtggatcactttcgcagaatgaaacgttntggtagaagtaaacgagtacgccgngtctaggtagaagggatacttccgaccgtactacgaaaggggtatacggaaccttaccgaaacgtagggttaggtttacgggaaccctaagtttttaaaccaaaagttcggaacggacctaaaacccgttgggaaaccggggaacccccggaaacggaacccaaccggtaacggggtcccgttacttaacgtttaaccgcggtccccggacccgtaaggggccggtaaacttcccgggttagggggaccgttccggaagttcgggacttagttttaggaagtttacggtttcgggggacccgtagggggttacctaaggttcggggtaacccg

SEQ ID NO: 397348 - DNA, 625 bp, Homo sapiens
  misc_feature: GZ8MTXP01BBH1V.44.71.G05.1.454.CMB.2.raw
  modified_base (399)..(399): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggctgttttaaaaggtgtccagtgtgaagtgcagctgttggagtcgggggagcttggtacagccggggggtccctgacactctcctgtgcagcctctggattcgcctttaatacctatgccatgatctgggtcctcaggccccagggaaggggctggagtgggtctcgatccattactggtggtagcgccacaaatgtcgcagactccgtgaacggccgtcttcatcccgtcctcgagggacattaccaagaatacggtgtttctgcagatgaaagngcctgcgagtgacgacacggtcccttatacgtgtgccaggggacggggtctacgaagtaagttaacaaactaaactaactaaagttaacttaacctacttaaccaagtacgggttacgtacgttacgggggaaccgaaaacgggggacccccgggttcgaacccggttccctacccggttccaaccggtccccttaccccgtaacccggaaaaccggggtcccccg

SEQ ID NO: 397349 - DNA, 639 bp, Homo sapiens
  misc_feature: GZ8MTXP01D221R.44.71.G05.1.454.CMB.2.raw
  modified_base (382)..(382): a, c, t, g, unknown or other
  modified_base (543)..(543): a, c, t, g, unknown or other
  modified_base (547)..(547): a, c, t, g, unknown or other
  modified_base (565)..(565): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgaggggcgactgggcgggaggtcgggggggggcttgggcacgagccagggcggtctctgagactctcctgtgtagtctcaggattcagttcttagtgtattatctacgtggcctgggtccgtcaggctccgaggggaagggcttggagtggatctactttcgtcaagtaatagtaaacgtttagtaggtaggaaagtaaaaggnggtaacgccgcgttcgtagtaggaagggggaatattccgaccgtctacggaaaggggtactcggaactaccaaacgtaggtcgttacgggacctaattttaacaaagttgaacgaccaacgtgaacggacccgaagaaccacgacggcgtactacgttacncgcnccgacggcgaatcccggngggacgttcgagtcgcgttagtttcgaagttacgtttcgggggaccgtagggggacctaagttcgggtaacccg

SEQ ID NO: 397350 - DNA, 617 bp, Homo sapiens
  misc_feature: GZ8MTXP01A92Y2.44.71.G05.1.454.CMB.2.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctcctgcactggaaaccacagtgacgtcggtcttttgaccgtgtctctggtaccagcacgaccccaagaaaccacgacccccaaatctaatttacttatgcgtacaattcgttacgtcccctttcggtcgtccctgacgcgtcttcctcgtgggtccaagtcgtaggccaacgaccggtccctccctcgacctactctcgtcggggcctccgacgggtctggaacggaccggaggctaggtaattagttactgcctaggtcctacaatacgtaacaaacggtggaaacctacgttctaacttacgtcggcgaacgaacggggaaccaacgttcgtacggtaacccgttcttcgggaccaacggtacccgaacggtccctaccggcccccttcgggttcccttaacccg

SEQ ID NO: 397351 - DNA, 642 bp, Homo sapiens
  misc_feature: GZ8MTXP01DMUWF.44.71.G05.1.454.CMB.2.raw
tcagacagtatatacacgaccggtgctcgatttagtgtcgtcgcaagagagaggaggggggggatctcaggaggcagctctctcggaatatctccaccatggcctgggctctgctcctcctcaccctcctcactcaggcacaggatcctgggctcagtctgccctggctcagccctccctccgtgtccgggtctcctggacagtcagtcaccatctctgcactgaaaccaacagtgacgtcggtcgtttgccgtgtctctggaccagcacgacccagaaacacgaccccaaactcattatttatgcgtacaatcgttccgcccttcggtctccctgacgcgtcccttcgtcgtcgggtaccaagtcgtcgggaaccaaacgtcccgggtacccttccccgtacgaaccctattcccgtccgtcggggccttaccgaggtccgtaggaacgggaccgaggtcctaggtaatttaactacgtcgtacaacgtcttacaaatacgtaaacgtaaagggtcggtaaaacctacttttaacgagttccggacgtaacggaacggacctaaacgcgtacgaacccggttaccgttaggccaaccggacccctaagggccctccggaccccgttcggttccctaacccg

SEQ ID NO: 397352 - DNA, 541 bp, Homo sapiens
  misc_feature: GZ8MTXP01DG2UM.44.71.G05.1.454.CMB.2.raw
  modified_base (227)..(227): a, c, t, g, unknown or other
  modified_base (322)..(322): a, c, t, g, unknown or other
  modified_base (359)..(359): a, c, t, g, unknown or other
tcagacagtatatacacgaccggtgctcgatttagtgtcgtcgcaagagagagggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaanagtgacgtcggtcttttgaccgtgtctctgtaccagcagaccccagaaacacgcccccaaatcattattatgcgtcaatgttccgccctttcggngtccctgacgcgcttcctctggtccagtctggcaacncgcctccctgaccatctctggctcgaggctgaggacgaggctgattatactgcaggctcatactacaagtggaaactactttactattacgacgtcaaagggcccaaaggccttaggtacccgtcgttaacgggttcaacgtccccaaagggccttccggcccccttcggtccaaccttccg

SEQ ID NO: 397353 - DNA, 663 bp, Homo sapiens
  misc_feature: GZ8MTXP01DV6I3.44.71.G05.1.454.CMB.2.raw
  modified_base (428)..(428): a, c, t, g, unknown or other
  modified_base (621)..(621): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtccagtgtgaagtgcagctgttggaggtcggggggaggcttggtacaggccgggggggtccctgacactctcctgtgcagcctctggattcgcctttaatacctatgccatgatcgtgggtccgtcacggccccgaggggaaggggctggaggtgggtctcatcctattacgtggtggtagtcgccaacaaatgtacgcagacctcccggtaggaacgggccgtcttcagtccgtccctacccgaaggggactaaatttacccaaaaagtaacttaacgggtgttttacngacaggataggaaagcgcctggcgagtcggaacgacgtacggtccctttataccgtgtacgccaggacggggggttcacgtaaagtaaacgttaacaaactaaataactaaagtacttaactaactacagtaacgggaacgttcgtacgggggaaccgtaaaacggggcccccgttcgacccgttccttcccnccgaacggacccctacccgaacccggaacgggcccctaacgg

SEQ ID NO: 397354 - DNA, 576 bp, Homo sapiens
  misc_feature: GZ8MTXP01DK6O5.44.71.G05.1.454.CMB.2.raw
  modified_base (404)..(404): a, c, t, g, unknown or other
  modified_base (426)..(426): a, c, t, g, unknown or other
  modified_base (438)..(438): a, c, t, g, unknown or other
  modified_base (503)..(503): a, c, t, g, unknown or other
  modified_base (519)..(519): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactggcgggaggtcgggggggggcttgggcacagccagggcggtctctgagactctcctgtgtagtctcaggattcagtcttagtgattatcactggcctgggtccgtcaggctccgaggggaaggggcttggagtggatctacgtttcgtcaagaatggaaaacgtttagtgggtaggaaagtaaaggaggtacgccgcgtctggtaggaaggggganattcgaccgtctacgaaagggntgactccaacgngttgttggacctaatttaacaaatgagacaacctgaacggacccgagaccacgaggctctatacngccgcaggcaatccgngggacttcgatgcttgttgaattaggttcggggccaggggactaagttcggtaaccc

SEQ ID NO: 397355 - DNA, 686 bp, Homo sapiens
  misc_feature: GZ8MTXP01EZ29I.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgtgaggggcgactggcggaggtcgggggggggcttggcacgagccgagggcggtctctgagactctcctgtgtagtctcaggattcagtcttagtgattatcactggcctgggtccgtcgaggctccgagggagggtcttgagtggatctactttcgcagaatgaaacgttatgggtaggaaagtaaagagtacgccgtcgtctaggtaggaagggaatagttccgaccggttcgtacgaaagggggtactcggaaccttacccgaaacgtaggttacggttcgggtacccctaaagttttaaaccaaaagttaggaacgaccctaaaccgttacggaaccgggaaccccggaaaccgaaccgaacgacgggtccgtacctaagtttaccgtgtccggacccgacgggcgaacgttcccggttggggtaccgttccggagtcggcttagttttggaagttacggttttcgggggacccgtaggggggaactaaacggttcgggtaaccccg

SEQ ID NO: 397356 - DNA, 569 bp, Homo sapiens
  misc_feature: GZ8MTXP01BNCEX.44.71.G05.1.454.CMB.2.raw
  modified_base (228)..(228): a, c, t, g, unknown or other
  modified_base (305)..(305): a, c, t, g, unknown or other
  modified_base (538)..(538): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccanagtgacgtcggtcgttttgaccgtgtctctggtaccagcacgaccccaagaaaccacgacccccaaatcattattangcgtcaatgttccgccctttcggtctccctgacgcgtcttcctcgtcgggtccaagtctaggaccaacgaccggtccctcccgtcgaccactcgtcctgggcctccgaggcgtggaggacgaggtctgattatactgcaggctacatatacgaagtggaactacgtttatacgttcggcgcgaacgggaccaaggcttgacccgtcgttaggttccacgccccaagggtcccnccggcccccgttcggtcccttaacgttcccg

SEQ ID NO: 397357 - DNA, 671 bp, Homo sapiens
  misc_feature: GZ8MTXP01AZO0X.44.71.G05.1.454.CMB.2.raw
  modified_base (584)..(584): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacaggccgaggggcggtctctgagactctcctgtgtagtctcaggtattcagtcttagtgtattatctacgtggccgttgggtccgtcgaggctccggaaggggaaggggtcttggaggtggactcgtaacttttcgacaagtaataggtaaacgtttagtaggggtaggaaaaggtaaacgaggtaacggccggtacgtcgtaagggtaggaaggggaaagtacgttaccgaccggttctacgaaaggggtatacggaactaccgaaacgtggttggttacggaccctaatttaacaaaagtggaagacccaaacgtgaacgggaaccccgaacggaacacgagggtctaccttagttaccnggccgccgaaggcgtaactccggttagggacttcggatcgattgttgaattaggttcggggacgtaggggactaagttcgggtaacc

SEQ ID NO: 397358 - DNA, 577 bp, Homo sapiens
  misc_feature: GZ8MTXP01EXA6P.44.71.G05.1.454.CMB.2.raw
  modified_base (355)..(355): a, c, t, g, unknown or other
  modified_base (377)..(377): a, c, t, g, unknown or other
  modified_base (394)..(394): a, c, t, g, unknown or other
  modified_base (424)..(424): a, c, t, g, unknown or other
  modified_base (453)..(453): a, c, t, g, unknown or other
  modified_base (487)..(487): a, c, t, g, unknown or other
  modified_base (526)..(526): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcggggggggggcttgggcacgagccgaggggcggtctctgagactctcctgtgtagtctcaggattcagttcttagtgtattatcactggcctgggtccgtcaggctccgagggagggcttggagtggatcactttcgcagaatgaaacgttnggtagaagtaacgagtacgcgngtctaggtagaaggganattcaccgtctacgaagggatgactcaacngtgtggacctatttacaaatgacacaacngacggacccgaacgacacgaggtctctattacgngccgaccagggcaactccggttagggacgttcgagtcgngttgtttgaagttagttcgggggccgagggggactaaggttcgggtaaccc

SEQ ID NO: 397359 - DNA, 526 bp, Homo sapiens
  misc_feature: GZ8MTXP01DIUPD.44.71.G05.1.454.CMB.2.raw
  modified_base (346)..(346): a, c, t, g, unknown or other
  modified_base (403)..(403): a, c, t, g, unknown or other
  modified_base (413)..(413): a, c, t, g, unknown or other
  modified_base (469)..(469): a, c, t, g, unknown or other
  modified_base (471)..(471): a, c, t, g, unknown or other
  modified_base (475)..(475): a, c, t, g, unknown or other
  modified_base (480)..(480): a, c, t, g, unknown or other
  modified_base (495)..(495): a, c, t, g, unknown or other
  modified_base (499)..(499): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactgggcgggaggtcgggggggggcttgggcacaggccaggggcggtctctgagactctcctgtgtagtctcaggattcagtcttagtgattatcactggcctgggtccgtcaggctccgagggagggcttgagtggatcactttcgcagaatgaaacgttnggtagaagtaaagagtacgccgcgtctagtgaagggagattcaccgtctcgaagggntgactccaangtgttaggctattacaatgagcaactgagaccccgagacacaggctctatactgcncngcgntccgngggacttgatgcttnttgnttagttgggcaggggacaagttggtcc

SEQ ID NO: 397360 - DNA, 573 bp, Homo sapiens
  misc_feature: GZ8MTXP01CRPP9.44.71.G05.1.454.CMB.2.raw
  modified_base (227)..(227): a, c, t, g, unknown or other
  modified_base (296)..(296): a, c, t, g, unknown or other
  modified_base (436)..(436): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctctgcactgaaccaacngtgacgtcggttcgtttgacgtgtctctgtacagcacgacccagaaacacgaccccaaatcattattangcgtacaatcgtcgcccttcggtctcctgacgcgtcttcctctcggctccaagtctcggcaaccgaccggccctccctgaccctatcctcgtggcctcgaggctggaggacgagctgtacttactactgcgtacgtctanaactaataccaaagcacgcaacgtcctaacccttgtcgttaccgttcggaaacgttcgggaaaccctagggttcccttacccggttccgtaagggtcccaacggaccccgaacggaccccaaacccgttgtaacccg

SEQ ID NO: 397361 - DNA, 590 bp, Homo sapiens
  misc_feature: GZ8MTXP01BUB6U.44.71.G05.1.454.CMB.2.raw
  modified_base (304)..(304): a, c, t, g, unknown or other
  modified_base (373)..(373): a, c, t, g, unknown or other
  modified_base (441)..(441): a, c, t, g, unknown or other
  modified_base (514)..(514): a, c, t, g, unknown or other
  modified_base (533)..(533): a, c, t, g, unknown or other
  modified_base (550)..(550): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgagccgaggggcggtctctgagactctcctgtgtagtctcgaggtattcagttcttagtgattatcactggcctgggtcctnaggctccgagggagggcttggagtggatcactttcgtcagaatgaaacgttatggtaggaaagtaaagngtacgccgcgtcgtaggtaggaagggatagttccgaaccgtctacgaaaggggatcgactccgaaacngttgttggacctaatttaacaaagtgagaccaaacgtgaacggaccccgagaaccacgaggccgtctaatacngaccgccgaggcaatccgnggggacttcgatgcttntttgaattaggttggggaccgaggggactaagttcggtcc

SEQ ID NO: 397362 - DNA, 814 bp, Homo sapiens
  misc_feature: GZ8MTXP01ASWT5.44.71.G05.1.454.CMB.2.raw
  modified_base (687)..(687): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgaggccgaggggcggtctcgtgagactctcctgtgtagtctcaggtattcagttcttagtgtattatcacgttggcctggggtccgtcgagggtcctacccggaagggggaacggggtcttagggaggttgggattccgtacgtttttcgactaagtaaacttaggtaaaacgtttagtaggggtagggaaaagtaaaacggtaggttaccggcccggtacggtcgttaagggtagggaaagggggaaactaacgtttacccgaacccggttcgtacggaaagggggtactacgggaacccttacccgaaaacgtggtttacgggtttacgggaacccctttaaattttaaaccgaaaagttcgggaaacgtaaccctaaaacccgttacgggaaacccggggtaacccccggaacggaaaccaacccggaaacggggtcccgttaaccgttaaatttacccgngggtacccgacccgtacggggtaccgtaacgtcccggttagggggacccttacggaagttcgactttggtttagaactttcgggtttaacggggaccctaagggggaaacctaagttcgggtaaccc

SEQ ID NO: 397363 - DNA, 614 bp, Homo sapiens
  misc_feature: GZ8MTXP01DIHCL.44.71.G05.1.454.CMB.2.raw
  modified_base (228)..(228): a, c, t, g, unknown or other
  modified_base (253)..(253): a, c, t, g, unknown or other
  modified_base (283)..(283): a, c, t, g, unknown or other
  modified_base (304)..(304): a, c, t, g, unknown or other
  modified_base (309)..(309): a, c, t, g, unknown or other
  modified_base (319)..(319): a, c, t, g, unknown or other
  modified_base (475)..(475): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccttgtccggtctcctggacagtcagtcaccatctcctgcactggaaccaanagtgacgttcggtcgttttgacgtntctctggtaccagcagaccccaagaaaccncgaccccaaatcaattattangcgtnaattcgtccncccttcggtctccctgacgtcgtcttcctcgtcgggtcctaagtcgtagggacctaaccgaccgggtcccttacccgtagaccctagtccttccgtcggggtcctcccgaagggtcctaggaacgggacgagggtccttagtatttaacgttccgngacacggtctacaataacgtaacgtaaggtacgtaaacttactttacgtagtccggacgacgaacggacagtcgacgtaccgtcgttagttccgaaccgtcccgaggtcctcccggtccccgttcggtccttccgtccg

SEQ ID NO: 397364 - DNA, 654 bp, Homo sapiens
  misc_feature: GZ8MTXP01C6EY0.44.71.G05.1.454.CMB.2.raw
  modified_base (310)..(310): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcacgcctccctccgtgtccggtctcctggacagtcagtcaccatctctgcactggaaccaacagtgacgtcggttcgtttgaccgtgtctcctggtaccagcacgaccccaagaaaccaccgacccccaaatctattattacngcgtacaattcgtcgtcccttccggtcgtccctgacgtcgtcttcccgtcgtcggtaccaagtccgtagggaccaacgcccggtccctcccgtacgaccctagtcctccggtcggtcccgtccgagggccgtaggacgggacacgggtccttagtaattactacgtgactacgtctactaagttaaacgaacgtaaacggtacggtaaaccctttaaacgttttacgtaacgttccgggaccgacgtaacggaaccttaggtccttaccgtaccgtaccgttacggccaccggaacccaacgggtccctcccgacccccgttggtaacccttaacgtttccccg

SEQ ID NO: 397365 - DNA, 705 bp, Homo sapiens
  misc_feature: GZ8MTXP01BCX7J.44.71.G05.1.454.CMB.2.raw
  modified_base (231)..(231): a, c, t, g, unknown or other
tcagacagtatatacacgaccggtgctcgatttagtgtcgtcgcaagagagaggaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctctgcactgaaccaanagtgacgtcgttcgttgaccgtgtctctgaccagcacgacccagaaacacgaccccaaatcattatttatgcggtacaatcgttccgtcccgttccggtctccctgacgtccgtccttctcgtcgggtccctaaggtcctacgggcctaaaccgacccgggtcccctccccgtacgaaccctacgttcccttccgtcggggcccttacccgagggtccgttagggaacggggaccgagggtccttaggtaatttacttaaccgttcggactaacggtcccttacaaagttaactaaaccgtaaaggttacgggaaaacctttacgttttaaccgttaaacgttccgggacgtaaccggaaacgggggttaacccaaaggttccgtacggtaaccccggttaccgttacgggttcccgaaccggaccccgaaacggggtcctaccccggcccccgttcgggttcccttaaccccg

SEQ ID NO: 397366 - DNA, 541 bp, Homo sapiens
  misc_feature: GZ8MTXP01AT7LE.44.71.G05.1.454.CMB.2.raw
  modified_base (344)..(344): a, c, t, g, unknown or other
  modified_base (383)..(383): a, c, t, g, unknown or other
  modified_base (498)..(498): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacagccaggggcggtctctgagactctcctgtgtagtctcaggattcagtcttagtgattatcactggcctgggtcctcaggctccgagggagggcttgagtggatcactttcgcagaatgaaacgttntgggtagaagtaaagagtacgcgcgtctagtgaaggganattcaccgtctcgaagggatgactcaacagtgttggcctattaacaatgagcaacctgacgacccgacgacacgaggcgtctatactgcgccaggcgaatccgttgggcgcgtangcttattgaataggttgggacagggggactaacgttgtaaccg

SEQ ID NO: 397367 - DNA, 609 bp, Homo sapiens
  misc_feature: GZ8MTXP01A51EU.44.71.G05.1.454.CMB.2.raw
  modified_base (296)..(296): a, c, t, g, unknown or other
  modified_base (394)..(394): a, c, t, g, unknown or other
  modified_base (540)..(540): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagtttttttagaaggtgtccagtgcgaggggcgactgggcggaggtcgggggggggcttggcacgagccagggcggtctctgagactctcctgtgtagtctcaggattcagtcttagtgattatcactggccgtgggtcccgtnacggctccgaggggaagggcttggagtggatcactttcgcagaataggaaacgttatggtaggaaagtaaagagtacgcgcgtcgtgtaggaaggganacttcaccgtctacgaaagggtatacggactaccgaacgtagtgttacggacctaatttaacaaagtagacgaccaaaccgtgaacgggaacccgacgaaccacgacggcgtactacgttacgtgccgcgacgggcgaactccggngggacgttcgagtcgcgttgtttagaagttacgtttggggccgtagggggactaagttcgggtaacccg

SEQ ID NO: 397368 - DNA, 768 bp, Homo sapiens
  misc_feature: GZ8MTXP01E34PY.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttggctaatcttgtattttccttgttagttttttagaggtgtccagtgcggaggggcgacgtgggcgggagggtcgggggggggcttggcacgaggccgaggggcggtctctgagacctctcctgtgtagtctcgaggtattcagttcttagtgtattatcacgttggccgtggggtccctcgacgggcctccggaagggggacgggtcttggagtggatctacttttcgcaagtaataggtaaaacgtttagtaggggtaaggaaagttaaaacggacggtacggcccggtacggtacgtaagggttagggaaagggggtaaatacgtttaccgacccgttacgtacggaaaggggtactcggaacctacccgaaacgtagttacggttacggacccttaagtttaacaaaagtgaacgtaccaaaccgtggaaccgggaaccccggaacgaaccaacgaacggtcccgttacttaaacgttacgtcggcccgacccgaacggggcccgtaaacgttcccgggttacggggaaccggttaccggaaacgttggaccgtttagttttcggtaaagtttacggggtttaacgggggaccccggtaaaggggggaacccttaaagggttcgggtttaaccccg

SEQ ID NO: 397369 - DNA, 835 bp, Homo sapiens
  misc_feature: GZ8MTXP01BZOLG.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctcgtgagactctcctgtgtagtctcgaggtattcagttcttagtgtatttatctacgtcggccgttggggtcccgtcgacgggccgttaccggaagggggaacgggggtcttggaggtgggtaacttccgtaacgttttcggtactaaaggtaaagttaggtaaaacggtttagtagggggtaagggtaaaaggtaaaaggtacggtaccggcccggtacggttacgtaagggtaagggaaggggtaagtacgttaccgacccggtcgtaacggaaaggggtatcggtaacctaccgaaacgtagggttggttacggaaccttaaagtttaaacgaaagttcggaaacgtacccgaaaaccgttcgggaaaccgggaacccccggaaacggaacccaaccggtaaacggggtcccgttaacttaacgtttaaccgcggtcccggtacccgtaaggggccgtaaccggttccccgggttagggggtaacccgttcggtaacgttggaacccgttttaggttttaggtaacggtttaacggggtttccggggggaaccggtaggggggttaaaccctaagggttttcggggtaacccc

SEQ ID NO: 397370 - DNA, 585 bp, Homo sapiens
  misc_feature: GZ8MTXP01B9ABB.44.71.G05.1.454.CMB.2.raw
  modified_base (435)..(435): a, c, t, g, unknown or other
  modified_base (445)..(445): a, c, t, g, unknown or other
  modified_base (499)..(499): a, c, t, g, unknown or other
  modified_base (505)..(505): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgaggggcgactgggcgggaggtcgggggggggcttgggcacgaggccgaggggcggtctctgagactctcctgtgtagtctcgaggtattcagttcttagtgatttatctacgtggcctggggtcccgtcaggcctccgaggggagggtcttggagtggatctactttcgacagtaatagaaacgtttagtggtaggaaagtaaagaggtacgccgtcgtctagggtagaaggggaatattccgacgtcacgagggntcgactcaanagtgtcgactattaacaatgacgacaactgacgaccccgagacaacgagtcgtnattcgngccgacgagggcaacgtcgaggggccttgagtgcttagttgaattggttcgggccgaggggactaacggttcggtaaccc

SEQ ID NO: 397371 - DNA, 595 bp, Homo sapiens
  misc_feature: GZ8MTXP01A90H5.44.71.G05.1.454.CMB.2.raw
  modified_base (229)..(229): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctcctgcactggaaaccaacngtgacgtcggtcgtttgaccgtgtctctggtacagcacgacccagaacacgaccccaaatcattattatgcgtcaatcgttcgccctttcggtctccctgacgtcgcttccctcgtgggtaccaagtctaggccaacgccggtccctccgtcgacctatcctcgtcgggcctccgaggtctggacggacgaggctagtattactactgcaggcttacattaactacgtaaggtaggaaacttacttttaacgtagtttccggcgccgaagggaacccaaaggtcccgttaggtaacccgttccgttagggttcccacgaaccccaagggtccctccgccccccgtttcggaaccttccgtttcccg

SEQ ID NO: 397372 - DNA, 581 bp, Homo sapiens
  misc_feature: GZ8MTXP01D50KL.44.71.G05.1.454.CMB.2.raw
  modified_base (363)..(363): a, c, t, g, unknown or other
  modified_base (373)..(373): a, c, t, g, unknown or other
  modified_base (390)..(390): a, c, t, g, unknown or other
  modified_base (424)..(424): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactggcgggaggtcggggggggcttgggcacagccaggggcggtctctgagactctcctgtgtagtctcaggattcagtcttagtgattatcactggcctgggtccgtcaggctccgagggagggcttggagtggatcactttcgcagtaatgaaacgttatggtaggaagtaaacgnggtacgccgngtctggtagaagggganattacaccgtctacgaagggtatgactccgaacngttagtcggtactatttaacaaatgaacgcaacgtgaacggacccgacgacacgaggcgtctactactacgcgtccaggccgtaatccgttgggacttcgagtgacgttgtttaggaattagggttcggggcgagggggactaagttcggtaacccg

SEQ ID NO: 397373 - DNA, 575 bp, Homo sapiens
  misc_feature: GZ8MTXP01CNH1J.44.71.G05.1.454.CMB.2.raw
  modified_base (418)..(418): a, c, t, g, unknown or other
  modified_base (453)..(453): a, c, t, g, unknown or other
  modified_base (491)..(491): a, c, t, g, unknown or other
  modified_base (509)..(509): a, c, t, g, unknown or other
  modified_base (528)..(528): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacaggccaggggcggtctctgagactctcctgtgtagtctcaggattcagttcttagtgattatcactggcctgggtcctcaggctccgagggagggcttgagtggatcactttcgcagtaatagaaacgttagtagggtaggaaagtaaaggagtacgccgtcgtctaagtaggaagggatattccgacgtctacgaagggntacgactacaacagtgtggacctattaacaatgancaactgacggacccgaagacacgaggcgtactattacngcgccagggccaatccgnggggtacttcgatgcgttntttcgtaataggtttggggaccgtagggggactaagttcgggtaacc

SEQ ID NO: 397374 - DNA, 572 bp, Homo sapiens
  misc_feature: GZ8MTXP01A3BKV.44.71.G05.1.454.CMB.2.raw
  modified_base (287)..(287): a, c, t, g, unknown or other
  modified_base (308)..(308): a, c, t, g, unknown or other
  modified_base (439)..(439): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaaccaacagtgacgtcggtcttttgaccgtgtctcctggtaccagcacgaccccaagaaaccncgacccccaaatcattattangcgtacaatgttccgccctttcggtgtccctgacgcgtctttcctcgtgggtcccaagtctacgggcaacgcggccctcctgaccatctcgtgggcctccgaggctggagacggagctgattatactgacnggctacatactaacgaagtcggaactactttacgtacgttcgcgcaacgggaccaaggccttacggtcccgttacgacggttccacggcccaagggtccctaccggcccccgttaggtcccaaccgtttcccg

SEQ ID NO: 397375 - DNA, 722 bp, Homo sapiens
  misc_feature: GZ8MTXP01AVR8J.44.71.G05.1.454.CMB.2.raw
  modified_base (303)..(303): a, c, t, g, unknown or other
  modified_base (308)..(308): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaaccacagtgacgtcggttcgttttgaccgtgtctctggtaccagcacgaccccagaaacacgccccaaatcattattangcgtnaatgtccgcccttcggtctccctgacgcgtcttcccgtacgtgggtccaagtcgtacgggacctaacgccgggtcccttcccgtagaccctatccgtcgtcggggccctacccggagggtcctagggagggtaccgagggtcctaggtaactttaacttaccgttgacaacgggtccttacgtaaacttaacgtaaccgtaaagggttccgggtaaaacctttacgttttaaccgtaacgtttcccggggaaccggtccgaaacgggggtaaccccaaaggggtccttacccgggtaaaccccggtttacccgttaacgggttcccttaaaccggggtaaccccccgaaagggtcccccgtttccccggaccccccccggttcgggttaacccccgttaaccgtttccccccgg

SEQ ID NO: 397376 - DNA, 638 bp, Homo sapiens
  misc_feature: GZ8MTXP01DUYT7.44.71.G05.1.454.CMB.2.raw
  modified_base (456)..(456): a, c, t, g, unknown or other
  modified_base (575)..(575): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggaggtcggggggggggcttgggcacgagccgaggggcggtctcgtgagactctcctgtgtagtctcaggattcagttcttagtgtattatctacttggcctgggtccgtcaggctccgaggggagggtcttggagtggactctactttcgcaagaatggaaacgtttagtgggtaggaaacgtaaaaggacggtacgcccggtacgttacgtaggtaggaaggggaagtactttaccgacccggttcacggaaagggggntacggacctaccaacgaggttgttcggacctatttaacaaatgaagacaaaccgtggaacggaaccccgacgaacacgaggtcctatacttactcggaccgccgaggccgaattccggngggaccttgatcggattgtttgaagttaggttcggggaccgaggggactaaggttgtaacccg

SEQ ID NO: 397377 - DNA, 712 bp, Homo sapiens
  misc_feature: GZ8MTXP01C8ZPD.44.71.G05.1.454.CMB.2.raw
  modified_base (306)..(306): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatcctgggctcagtctgccctggctcacgcctccctcgtgtccggtctcctggacagtcagtcaccatctcctgcactggaaaccaacagtgacgttcggtcgttttgaccgtgtctcctggtaccagcacgacccaagaaacacgacccccaaatcaattattangcgtcaatcgttcgccctttcggtcgtccctgacgcgtcctttccctcgtcggggtaccctaaaggtccgtaacgggacctaaccgacccgggtccccttaccccgtacggaacccctaacgttccgtccgtcggggtcctacccggaagggtccgttagggaacgggaacggtaacggggccttaggtaaactttaatttaacgtcgtaccgtaagggtcccttacgtaaattaacgtaaaccgtaaaaggttacgggtaaaacctttaacgttttaacttaacgtttaccggccggacgtaaacggggtaacccaaggtccgttacgtacccgtaccgttaacgggttcaaccggaacccgaaaggtcccgttaccgcccccgttcggtccttaaccgttcccg

SEQ ID NO: 397378 - DNA, 755 bp, Homo sapiens
  misc_feature: GZ8MTXP01BFJGJ.44.71.G05.1.454.CMB.2.raw
  modified_base (215)..(215): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctccgnactgaaccaacagtgtacgtcggtcgtttcgtacgcgtctctcgtacgtacgcacgacccgaaccgaaacaaccgacccccgtaaacctactactttaacttttactagtaccggtactaacttagtttccgttccccgttcccggtttcggttcccgttcgtaggccgtccgtttctcccggttaccggggttccgtaaacgtcgtccgggtaaccgaaccctaacccgggtccccgtcccccttacggacccctaacgttccgttccgtcggggtacccgttcccgtacgggacgttcgggaaacgggacggtaaacggggtccttagtaaacgttttactttaacgtcggtcgaacgccgttactaaactaaactaaccgttaaaagggtccgggaaacgtttaaacttttacccgttaagttccgggccgacggtaacgggaacccaaaggttcgtaccgttaaccggtccctagggttacgaccgttcccgaacgggccttccggcccccgttcggctaaccgttcccgttcccg

SEQ ID NO: 397379 - DNA, 745 bp, Homo sapiens
  misc_feature: GZ8MTXP01C26UF.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttcttgttagttttttagaaggtgtccagtgcgaggggcgactgggcgggaggtcggggggggggcttgggcacgaggccgaggggccggtctcgtgacgactctcctgtgtagtctcgaggattcagttcttagtgtattatctacgtcggcctggggtcccgtacgagggcctacccggaagggggtaacggggtccttgggaggttgggacttaccgttacgtttcgtacgaaaggtaacgtacggtaaaacgtttagtaggggtaaggtaaaaggttaaaaggacggttaacgccggtacggttcgtaagggtaaggaacggggaagtaacgttaccgaccggttcgtaacggaaaggggtatacgaccttaccgaaacgtgttagttacggaccttaaatttaaccgaaagtcggaaacgacctaaaccgtaggaacggaaccccggaagaaccacgacgggtccgttacctaagttaccgtcgccgaccgagggccgtaacgtccggttggggtacttcggtaagttcggactttagtttcggtaagtttacggttcgggggaccgtagggggactaaacgggttcggtaacccg

SEQ ID NO: 397380 - DNA, 699 bp, Homo sapiens
  misc_feature: GZ8MTXP01AMFBC.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcggggggggggcttggcacgagccgaggggcggtctctgagactctcctgtgtagtctcgaggtattcagttcttagtgtattatctacgtggccgtgggtccgtcgaggcctaccggaggggagggtctggagtggactctacgtttcgacaagataggtaaacgttgtagggtaggaaagtaaagagtacggcgtcgtcgtaaggtaggaaggggaatacgttaccgacccggttcgtacgaaagggggtactacggaaccctacccgaaagtggttaggttacgggacccttaagtttaaaccaaaagtcggaacgtacctaaaccgtggaaaccggggaccccgaaggaacctacgacgggtccttactaagttaccggcgcccggtaacccgagggccgtaacgttcccgggttagggggacccttgaagtcgacttgtttaggaacgttgggttcgggggaccgtagggggacctaagggttcggtaaccc

SEQ ID NO: 397381 - DNA, 653 bp, Homo sapiens
  misc_feature: GZ8MTXP01AQLWT.44.71.G05.1.454.CMB.2.raw
  modified_base (230)..(230): a, c, t, g, unknown or other
  modified_base (302)..(302): a, c, t, g, unknown or other
  modified_base (308)..(308): a, c, t, g, unknown or other
  modified_base (327)..(327): a, c, t, g, unknown or other
tcagacagtatatacacgaccggtgctcgatttagtgtcgtcgcaagagagaggaggggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactgaaccanagtgacgtcgtcgtttgaccgtgtctctggtaccagcacgacccagaaaccacgaccccaaatcattattangcgtanatcgtccgtcccttcggtntccctgagtccgtcccttctcgtcgggtacctaagtctcggccaaaccgccggtccctccctagacccattcctcgtacgggcctccgacggcgtaggaacgggtaccggtagggtccttaggttaactttaacgttacgttcggacctacggtaccttaccaaagttaaccgtaaacgtaaacggtacggggtaaacccttaacgttttacccgtagtttaccggcgaacgtaacgggaaccctaagcgtacgtaaccccggttccgttacggttaccaaccggacccgaacggtcccgtccggccccccttgggttccctcccg

SEQ ID NO: 397382 - DNA, 748 bp, Homo sapiens
  misc_feature: GZ8MTXP01BVWOM.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgaggggcgactgggcgggaggtcgggggggggcttgggcacgagccgagggcggtctctgagactctcctgtgtagtctcgaggtattcagttcttagtgtattatctacgtggccgtcgggtccgtcgacggccgtccggaagggggaaggggtcttggagtggatctacgtttcgtacaagtaagtaggtaaacgtttagtagggtaggaaaggtaaaagacggtacgcccggtcgtcgtaaggtaggaaggggtaagtacgttacgacccggtcgtacggaaaggggtatacggaacctaccgaacgtaggttggttacgggtaccctaaattttaaccgaaagttcggaacgtaccaaaccgttaggaaaccggggtaaccccggaacgaacccgaacgtaccgggtccgttaccttaacgttaccgcggtacccgaccgtacgggccgaacgttccccggttagggggtaccgttcgtaaacgtggttccgtttaggtttacggtaagttttacgggtttccggggggacctaagggggttacctaaacgttcgggttaaccccg

SEQ ID NO: 397383 - DNA, 804 bp, Homo sapiens
  misc_feature: GZ8MTXP01EOOHB.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcgcgaggccgaggggcggtctctgagactctcctgtgtagtctcgaggtattcagttcttagtgtattatcacgtggccgtgggtccgtcgaggcctccgaggggagggtcttggagtggatcgtactttcgacaagtaataggtaaaacgtttagtaggggtaaggaaaacgttaaaaggacggttaacggcccggtcgtacgttagggtaagggaagggggtaaatacgtttacccgacccggttcgtacgggaaaagggggtactacggtaacctacccgaaacgtaggtttggttacgggtaacccttaaagttttaaacaaaagttcggaacgtaaccctaaaccggttacggaaaccggggaaacccccggaaacggtaaacccgaaaccggaacggggttacccggttaaccttaacgtttaaacccgtcggtaccccggtaccgaacgggggtccgtaaacgttccccgggttaagggggtacccgttccggtaagttcgggttaccttagttttaggaaggtttacgggtttcggggacccgtaagggggttacctaaaggttcgggttaacccg

SEQ ID NO: 397384 - DNA, 815 bp, Homo sapiens
  misc_feature: GZ8MTXP01D1URU.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctcgtgagactctcctgtgtagtctcgaggtattcagttcttagtgtattatctacgtcggccgtggggtcccgtcgacgggtcctccggaagggggtaagggggtctttgggaggtgggtacttccgtaacgttttcggtacaagtaaagttacggtaaaacgtttagtaggggtaaggtaaaacggtaaaaggacggtacgccggtacgtcgtaaggtaggaaggggaatacttccgaaccgttctaacgggaaaggggtactacggaaccttaccgaaacgtaggttaggttacgggtaaccttaaattttaaaccaaaagttcggaaacgaacctaaacccgttaggaaaccggggaaacccccgaaacggaaccaaccggaacggggtcccgttacttaaacgtttaaccgtcggtacccggtaccccgtaggggacccgtaacgttccccggttaggggggtaaccccttcggaaacgttgggacctttaagtttacgggtaagttttaacgggtttaacggggggacccggtaaggggggttaaaccttaagggttccgggtttaacccg

SEQ ID NO: 397385 - DNA, 612 bp, Homo sapiens
  misc_feature: GZ8MTXP01AJ0IL.44.71.G05.1.454.CMB.2.raw
  modified_base (224)..(224): a, c, t, g, unknown or other
  modified_base (296)..(296): a, c, t, g, unknown or other
  modified_base (326)..(326): a, c, t, g, unknown or other
  modified_base (437)..(437): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatctctgcactgaaccanagtgacgtggtctttgaccgtgtctctggtaccagcacgaccccagaaacacgacccccaaatcattattangcggtacaagtcgttccgtcccttccggtntcccctgagccgtcttcctacgtgggtccaagtcgtaggaccaacgtaccggccctacccgtgaccctagtctctcgggcctaccggaggtccgtaggacgggtaaccggnggtactagtaacttaccgtacgtacgacctacggtctacgaagtaactaacgacgcaacgcctacgtacccctacccgttagtccgtccgttaacggaacgtcgggaaccgtaacggtacccttccgttcgttacgtaaccacgaacccgaaccgccccaacccgtcgttcgtcc

SEQ ID NO: 397386 - DNA, 754 bp, Homo sapiens
  misc_feature: GZ8MTXP01AETGO.44.71.G05.1.454.CMB.2.raw
  modified_base (233)..(233): a, c, t, g, unknown or other
  modified_base (289)..(289): a, c, t, g, unknown or other
  modified_base (309)..(309): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctccgtggacaggtcagtcaccatcctctgcactggaaaccaanagtgacgttcggtcgttttgaccgtgtctcctggtaccagcacgaccccagaaacncgaccccaaatctattattngcgtacaagttcgttccgtccctttcggtctccctggactccgtctttccctcgttacggggtaccctaaaggttccgtaacgggacctaaccgacccgggtcccccttacccgttacggaaccccttaagttcccttaccgggtcgggggtacccttcccggaacgggtcgtacgggaacggggaacccggtaggggtccttaagggtaactttaacgtttaaccgtcggtacctacggggtaccttaacgtaattaaacgttaacgtaaacgggttacgggtaaacctttaaccgttttaacgtaacgtttccgggaccgtaccggtaacggggaaccttaaacggccgttaacgggtaacccgttaaccggaacgggttccgacccggtaacccgaagggtccctacccggtccccgttacggtccgttaaccgtttccccg

SEQ ID NO: 397387 - DNA, 663 bp, Homo sapiens
  misc_feature: GZ8MTXP01BBVLN.44.71.G05.1.454.CMB.2.raw
  modified_base (311)..(311): a, c, t, g, unknown or other
  modified_base (398)..(398): a, c, t, g, unknown or other
  modified_base (438)..(438): a, c, t, g, unknown or other
  modified_base (525)..(525): a, c, t, g, unknown or other
tcagacagtatatacacgaccggtgctcgatttagtgtcgtcgcaagagagaggagcccccacccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctctgagactctcctgtgtagtctcgaggtattcagttcttagtgtatttatcacttggcctgggtcccgtnaggcctccgaggggagggcttggagtggatctacgtttcgcaggaataggaaacgtttatgggtaggaaagtaaagacgtacgccgngtctggtaagaaagggaatattcgaccgtcacgaaggggntacgactacaaacgtagtgttacggacctaatttaacaaatgacgacaactgaacgacccgagacacgaggtccgtactacgttacncgtccgaccgagggccgaacgttcccggtagggggaccgttcgaagttcggtaccttaaggttttgaaacgttttaagggtttccggggggaacccgtaaggggggaaccttaagggttccgggttcctaaccccggg

SEQ ID NO: 397388 - DNA, 690 bp, Homo sapiens
  misc_feature: GZ8MTXP01APIXL.44.71.G05.1.454.CMB.2.raw
  modified_base (296)..(296): a, c, t, g, unknown or other
  modified_base (348)..(348): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgaggggcgactgggcggaggtcggggggggggcttggcacagccgagggcggtctctgagactctcctgtgtagtctcaggattcagtcttagtgattatcactggcctgggtccgtnaggctccgagggagggctgagtggatctactttcgcagtaatgtaaacgttntgggtaggtaaagtaaacgaggtacgcccggtcggttactagggtacggaaggggaagtactttaccgaccgtctacgaaagggggtatacggaccctccgaaacgtaggttcgttacgggacctaattttaaacaaagttggaacgacctaaaccgttggaaacccgggaaccccggacgtaacccaaacggtacgggtccgtacttaacgtttaccgcggtcccgaccccgtaggggccgaacgttccccggttaggggtccggttacgtaagtccggattgtttagggaagttagtttcggggggcccaagggggttactaacggtttcggggtaaccc

SEQ ID NO: 397389 - DNA, 821 bp, Homo sapiens
  misc_feature: GZ8MTXP01ENNJG.44.71.G05.1.454.CMB.2.raw
tcagacagtatatacacgaccggtgctcgatttagtgtcgtcgcaagagagaggagcccagccctggggactgaacagagagaactcaccatggagtttgggctgagctggctttttcttgtggcttgttttaaaaggtgtccagtgtgaagtgcagctgttggaggtcgggggaggcttggtacgaggccgggggggtccctgacactctcctgtgcagcctctggtattccgtacctttaatacctatcgccatgtatcgtgggtccctcgacggccccgaggggagggctgggagtcggtctcgatcctattacgtgggtggtagtcgacccaagaaatgtacgacgacgtaccttcccggtagggaacggtcccgtcttacgacgttccccggtacctaccgaaggggtaacctaaacgtttaacccgaaaagtaacgttacgggtttgtttaccgtagacgtaaggagttaaggaagacgtccgtaggccggtaaggtacgggtaaacccgaccgtaacccgggttacccttttaagttaccgttggtaccggtacccggaaagggggtacggggtacgtaaccgaaagggtaaaaccgttaaaccaaaagtaaacttaaaaccgtaaacgttaaactttaaaccttaaaccgtaaaccgtaaaggttacgggttaacccggtttaacggggaccgggggttaaaaccggaaaaccccgggggttaccccgttacccgttacccggttaacccgttacccaaccgtaaacccgcccccgttaaccgaaaccccgggttaaaccgggtaaccccccg

SEQ ID NO: 397390 - DNA, 666 bp, Homo sapiens
  misc_feature: GZ8MTXP01BNUUN.44.71.G05.1.454.CMB.2.raw
  modified_base (233)..(233): a, c, t, g, unknown or other
  modified_base (313)..(313): a, c, t, g, unknown or other
  modified_base (410)..(410): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaaccaacngtgacgtcggttcgttttgaccgtgtctcgtggtaccagcacgacccaagaaaccacgaccccaaactctaattatttangtcgtacaatcgttccgtccctttcggtcgtccctgacgtcgtcttcctcgtcggtaccagtcgtaggaccaacgccggccctcccgtcgaaccctntccgtcgtcgggtcctccgagggtcgtaggacgggaacggaggtcctaggtaatttacttacgtgaccgtaggtcttaacgtaattaacgtaaacgtaaacgggttacggtaaaccttaaaccgttttacgtacgttaccgggaccgtacgaaacggggtaccaaaggtccgttacggtacccgttccgttaaggttccaccggtaaccccgaacggtcccgtacccgtccccgttacggtcccttccgtttcccg

SEQ ID NO: 397391 - DNA, 623 bp, Homo sapiens
  misc_feature: GZ8MTXP01AH36B.44.71.G05.1.454.CMB.2.raw
  modified_base (229)..(229): a, c, t, g, unknown or other
  modified_base (304)..(304): a, c, t, g, unknown or other
  modified_base (310)..(310): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaanagtgacgtcggtcgtttgaccgtgtctctggtaccagcagaccccagaaaccacgacccccaaatcaattattangacgtnaattcgttccgtccctttccggtctccctgacgcgtcttcctcgtgggtaccaagtctgggaccaacgaccggccctacccgtcgaccctatcctcgtcgggcctcccgaggtctggacgggacgaggtctagtacttatacgtgcaggtctacatatacgtaaggtaggaaacttactttaactacgttcgggaccgcgaacgggaccaaaggtcccgttacggtaaccccggttccgttacgggttcccaacggtaaccccgtaagggcccttcccggccccccgttacgggtccttaacccgtttccccg

SEQ ID NO: 397392 - DNA, 720 bp, Homo sapiens
  misc_feature: GZ8MTXP01BQ8SD.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttggctaatcttgtattttccttgttagttttttagaaggtgtccagtgtggagggcgactgggcgggaggtcgggggggggcttggcacgaggccaggggcggtctcgtgagactctcctgtgtagtctcaggtattcgagttcttagtgtattatctacgtggcctggggttcctgaggctccggaggggagggtctggagtggactctactttcgtcaagtaagtaggtaaacgtttagtagggtaggtaaagtaaacggtacgtacggccgtacgtcgtaaggtagggaagggaacgtacgttaccgaccgttacgtacggaaagggggtatacggtaacctacccgaaagtggtttacggttcggtaaccctagttttaaacgaaagtggaacgtaccaaacgtcggaaccggggaacccgaacgaccaaacggtggaccctttagtaacgtttaccgcgtaccggaccgtaaggggtcctaacggtcccggttagggggtaaccttggtaaacgtcgaccgttttagttacggttaagttaggggtttccggggacggtaacgggggactaagggttccgtaacccg

SEQ ID NO: 397393 - DNA, 644 bp, Homo sapiens
  misc_feature: GZ8MTXP01BY5CA.44.71.G05.1.454.CMB.2.raw
  modified_base (282)..(282): a, c, t, g, unknown or other
  modified_base (564)..(564): a, c, t, g, unknown or other
  modified_base (580)..(580): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcgggaggtcgggggggggcttgggcacgagccgaggggcggtctctgagactctcctgtgtagtctcaggtattcagttcttagtgattanctacgtggcctgggtccgtcgaggctccgagggagggcttggagtggatctacgtttcgtacaagtaataggtaaaacgtttagtagggtaggtaaaggtaaaagacggtacgcccggtacgttcgtaagggtagggaaggggaaagtactttacccgacccgtcgtacggaaaggggatcggaactacccgaaagtggttgttacggacccttaagtttaaaccaaagtgaacgactaaaccgtgaaccggacccgacgacacgaggtcctactattacgngccgccaggcaatcgnggggacttcgatcgacttgttcgaattggttggggcccgaggggttactaaggttcggtaaccc

SEQ ID NO: 397394 - DNA, 677 bp, Homo sapiens
  misc_feature: GZ8MTXP01BHZ2F.44.71.G05.1.454.CMB.2.raw
  modified_base (230)..(230): a, c, t, g, unknown or other
  modified_base (287)..(287): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccaacngtgacgtcggttcgtttgaccgtgtctccgtggtaccagcacgaccccaagaaaccncgacccccaaatctaattattatgcgtacaatcgttccgtcccctttcggtctcccctgacgtccgtctttccctcgtcggggtaccctaaggttccgtacggaccaaccgtcccgggcccttcccgtacgacctactccgtcgtcgggtcctaccgaggcctaggacggacgaggtctagtaattacttaccgtgactacggtcttacgaagttacgtaaacgtaacggttaacgggtaaaccttaacgttttactaaggttccggaccgaccggtaacgggtaaccaaacggtccttaccggtacccgtaaccgttacgggttccaaccggtaacccctaacgggtcctaccccggtccccgttcgggtaacccttaacccgttcccg

SEQ ID NO: 397395 - DNA, 910 bp, Homo sapiens
  misc_feature: GZ8MTXP01A502Z.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttggctatcttgtattttcttgttagttttttagaggtgtccagtgcggagggcgacgtgggcgggagggtcgggggggggcttggcacgaggccgaggggcggtctcgtgagtcctctcctgtgtagtctcgagtattcagttcttagtgatttatctacgtcggccgtagggtcccgtacgacgggtccgtccggaagggggaacggggtccttgggaaggtgggtacttaccgtacgttttcgacgtaaaggtaaagttacgggtaaaacgtttagtagggggttaaagggtaaacgttaaaaccgggtacggtaccggaccggtaccggttaccgttaagggttaacggggaaagggggtaaacgttaaacgtttaccccggtaaacccgggttccgttaaaccggggaaagggggtaacttaccgggaaacccttaccccggtaaaaagtcggggttttacggttaccgggttaacccttaaagttttttaaacccgaaaaggttccggaaacgttaaccccgaaaacccgtttacgggggaaaccccggaaaccccccgggtaaacggaaaccccgtaacgggtaacggggtcccgtttaccgttaaacgttttaaccggccggtaccccggtaccgaacgggggtcctaaccgggttaccgggttcgggggtaacccgttggtaaacgtttcggacctttacggtttagggtaacgtttaggggtttcccggggggaccaagggggttacctaacggggttcccgggttaaccccg

SEQ ID NO: 397396 - DNA, 737 bp, Homo sapiens
  misc_feature: GZ8MTXP01DBCRG.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagttggctaatcttgtattttcttgttagttttttagaggtgtccagtgcggagggcgacgtgggcgggagggtcgggggggggcttggcacgagccgagggcggtctctgagactctcctgtgtagtctcgaggtattcagttcttagtgtatttatctacgtcggccgtcgggtcccgtacgacgggtcctccggaagggggtaacggggtcgttagggaggtgggtacttaccgttacgttttccggtacgtaaaggtaaagtaggtaaaacggtttagtaggggtaaggtaaaagtaaaacggaggtaacggccgtcgtacgtaaggtaggaaggggaatacgttaccgaccgtcgtacggaagggactacgaacctaccaaacgtgttacggttacggaaccttaaagtttaacgaaagttggaaacgaacctaaaccgtggaaccgggaaccccgacgaaccgacgacggtccttacttaagttaccgcgaccgaccgaggccgtaacgtccggttaggggaccgttacgagtcgttacgtttagtttacgaagtttacgggttcgggggacccgtaagggggttacctaaggttccgggtaacccg

SEQ ID NO: 397397 - DNA, 773 bp, Homo sapiens
  misc_feature: GZ8MTXP01EES33.44.71.G05.1.454.CMB.2.raw
  modified_base (200)..(200): a, c, t, g, unknown or other
  modified_base (228)..(228): a, c, t, g, unknown or other
  modified_base (304)..(304): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcaggcacaggatcctggctcagtctgccctggctcacgcctccctccgtcgtccgggtctccgtggacngtcagtcaccatctctgcactgaaccanagtgacgtcggtcgtttgacgtgtctctgtacagcacgacccaagaaccacgaccccaaatcattattatgcgtanaattcgttccgtccctttcggtctcctgacgtccgtctttcccgtcgtacgggtacctaagttcgtaacgggaccaaccgtaccgggtccccttcccgtacgtaccctacgttccttacgggttcggggcccttcccggaagggtccgttaaggggaaacgggtaaccccgggtaagggttccttaaagggttaactttaactttaaccggacgtccctaaacggggttcctttacaaaagtttaaaccgtaaccggtaaaacggtttcggggtaaaaccctttaacctttttaaaccgtacgggtttaccgggggaccctaacgggaaaacggggtaaccccttaaaggggttcccttaacccggggaaaccccgtttacgttaaacggggttccccaccgggttaaccccgaacgggttcccttccccgggtacccccttcggggtaaccccttaacgtttcccccg

SEQ ID NO: 397398 - DNA, 691 bp, Homo sapiens
  misc_feature: GZ8MTXP01AEE2I.44.71.G05.1.454.CMB.2.raw
  modified_base (242)..(242): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcgggaggggtcgggggggggcttgggcacgaggccgaggggcgtctcgngagactctccgtgtgtagtctcgaggtattcgagttcttagtgtattatcacgtggcctcgggtccgtcgaggtcctacggagggaggggtcttggagtggtacttcgtacgttttcggactaaggtaacgttaaggtaaacgtttagtaggggttaaggaaacgtaaagacggtacgcgtacgtcgtagtaggaagggatacttaccgacgtctaggaagggactacgaccttacaaagtgttagttcggaccttaattaacaagtcgaacgaaccaaccgtacggaaccgggaacccggaacgaaccgaacggaccgtcgttactaacgttacgtacgccgtacgcggactaacgtcccggttggggacccttgaacgttcggttacttcgttagtaaggtttgggttaacgggaccgggtaaggaccgtaacggttcgttaacccg

SEQ ID NO: 397399 - DNA, 637 bp, Homo sapiens
  misc_feature: GZ8MTXP01AUM1W.44.71.G05.1.454.CMB.2.raw
  modified_base (231)..(231): a, c, t, g, unknown or other
  modified_base (249)..(249): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagccctccctcgtgtcccggtctcctggacagtcagtcaccatctcctgcactggaaacccanagtgacgttggtcttttnaccgtgtctctggtaccagcacgaccccagaaacacgccccaaactcattacttatgtcgtacaattcgtccgccccttcggtctccctgacgcgtcttctccgtgggtcaagtctacggaccaacgtcggccctacctcgacctatctcggcgggtcctccggagccgtacggaggtaaccggaggtcgttaaggtactttaaacttccggttgacccggtagtacccttacggtaaacttaaactaaccggtaaaggtacggggtaaaccttaccgttttaaccgttaacgttccggtacgacgaaccggggtaaacacgggtcttacggacccgttacgagttccaccggcctaagggcctcggccccttggccttaacttcccg

SEQ ID NO: 397400 - DNA, 717 bp, Homo sapiens
  misc_feature: GZ8MTXP01A1E9F.44.71.G05.1.454.CMB.2.raw
  modified_base (379)..(379): a, c, t, g, unknown or other
  modified_base (397)..(397): a, c, t, g, unknown or other
tcagacagtatatacacgaccggtgctcgatttagtgtcgtcgcaagagagaggagccccatccgtgagattcccaggagtttccacttggtgatcagcactgagcacagacccaccaaccatggagttggctaatcttgtattttccttgttagtttttagaaggtgtccagtgcggaggggcgacgtgggcgggagggtcgggggggggcttgggcacgaggccgaggggccggtctcgtggacgtactctccgtgtgtagtctcgaggtattcgagttcttagtgtattatcactggcctgggtcctacgaggtcctccgaaggggaacgggtcttaggacgtggactctaactttcgacagaaatgaaacgttgnggtaggtaaagtaaaagngtaacgcgacgtcgtaagtaggaaggggaatacttaccaccgtactacgaaagggtatacgaaccttacgaaacgacggttagtttacgggaccctaagttttaaaccaaagttcgaacgacctaaaccgtgaaccgggaacccgaaacgaccgaacgtacgggtactacccgttaatttaccgagtaccggacccacggggtcgtaaacctccggttgggggaaaccgttccggtaaacgttggaccttaagggttttgaaagtttacgggtttcggggacccggttaaagggggacccttaaggttccgtaacccggg

SEQ ID NO: 397401 - DNA, 577 bp, Homo sapiens
  misc_feature: GZ8MTXP01ATN3U.44.71.G05.1.454.CMB.2.raw
  modified_base (334)..(334): a, c, t, g, unknown or other
  modified_base (348)..(348): a, c, t, g, unknown or other
  modified_base (364)..(364): a, c, t, g, unknown or other
  modified_base (397)..(397): a, c, t, g, unknown or other
  modified_base (489)..(489): a, c, t, g, unknown or other
  modified_base (510)..(510): a, c, t, g, unknown or other
  modified_base (532)..(532): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgagggcgactggcggaggtcggggggggcttggcacagccagggcggtctctgagactctcctgtgtagtctcaggtattcagttcttagtgattatcacgttggcctgggtcctcagggcctccgaggggaagggcttggagtggatcactttcgnagaatgaaacgttnggtagaaagtaaacgngtacgcgcgtctagtgaaggaagattcaccgtntacgaaagggatgactaccaacgagttgtacgacctaattttaacaaatgacgcaacctgacggacccgagacactaaggctactattacgngccgccgtaggcgaatcccgnggggacttcggaatcgacgttntttgaattaggttcggggactagggggactaagttcgggtaaccc

SEQ ID NO: 397402 - DNA, 727 bp, Homo sapiens
  misc_feature: GZ8MTXP01BPAAS.44.71.G05.1.454.CMB.2.raw
  modified_base (301)..(301): a, c, t, g, unknown or other
  modified_base (323)..(323): a, c, t, g, unknown or other
  modified_base (487)..(487): a, c, t, g, unknown or other
tcagacagtatatacacgaccggtgctcgatttagtgtcgtcgcaagagagagggggggggatctcaggaggcagctctctcggaatatctccaccatggcctgggctctgctcctcctcaccctcctcactcagggcacaggatcctgggctcagtctcgccctggctcacgcctccctccgtcggtccggtctccgtggacagtcacgtccacctatcctcctcgcactacggaaaccaacgagtcgtacgttcggttcgtttcgaccgtgtctcgtgtaccagcacgacccaagaacnccacccctaatctattattagngtcgtactagtcgttccgccccgtttcggtctccgtgacgtcgtcctttccgtcgtcgggtacccgtaacgtccgtaacggaccctaacgtcccgggtcccccttacccgtcgtaacctcgttacgtccgtcgggcctccggagggtcgtagggacgggtacgnggtccttagtattactagtcgactaagtaacgttaaatacggtaacgtaaacggttacggtaaactttacgtttaccggtagttacccggggacgtacggtaaacgggaaccgtaagttcccggttaacggccccgttaacggttaccggccgaacccgggttacccgtaaccggtccccgttaacccggtcccccccgtttaggttacccctaacccggttttccccgttaacccccgg

SEQ ID NO: 397403 - DNA, 554 bp, Homo sapiens
  misc_feature: GZ8MTXP02J1G6O.44.71.G05.1.454.CMB.2.raw
  modified_base (376)..(376): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtccagtgtgaagtgcagctgttggagtcgggggaggcttggtacaggccggggggtccctgacactctcctgtgcagcctctggattcgcctttaatacctatgccatgatctgggtccgtcaggccccagggaaggggctggagtgggtctcatccattactggtgtagtgccacaaatgtcgcagactcgtgaagggccgcttcatcgtcctccgaggacaattccaagatcggtntttctgcagatgaagagcctgcgagtggacgacacggccctttatactgtgccgaggagggtcgcagaacgttacaaacaataacaagtattaactactacatggacgtcgtcggggacaaacggggaccccgtcaacccggtctccgtcacgccctaccaccgaaacgggccctacg

SEQ ID NO: 397404 - DNA, 513 bp, Homo sapiens
  misc_feature: GZ8MTXP02IXT1B.44.71.G05.1.454.CMB.2.raw
  modified_base (326)..(326): a, c, t, g, unknown or other
  modified_base (402)..(402): a, c, t, g, unknown or other
tcagacagtatatacacgaccggtgctcgatttagtgtcgtcgcaagagagagggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacagcccccaaatcattatttatgcggtcaatgttcgcccttccggtntcccctgagcgcttctctgggtccaagtctggcacacggcctccctgacccatctctgggctccgagctgagacgnggctgattatactgcagctcatatacaagtggaactactttaactattcgcgcaagggaccaaagctgaccgtcctaggtcagcccaaggctcgcccctcggtcacttccg

SEQ ID NO: 397405 - DNA, 593 bp, Homo sapiens
  misc_feature: GZ8MTXP02HK2V4.44.71.G05.1.454.CMB.2.raw
  modified_base (301)..(301): a, c, t, g, unknown or other
  modified_base (315)..(315): a, c, t, g, unknown or other
  modified_base (393)..(393): a, c, t, g, unknown or other
tcagacagtatatacacgaccggtgctcgatttagtgtcgtcgcaagagagaggagcccagccctggggactgaacagagagaactcaccatggagtttgggctgagctggcttttctgtggctgttttaaaaggtgtccagtgtgaagtgcagctgttggagtcggggggaggcttggtacaggccggggggtccctgacactctcctgtgcagcctctggattcgcctttaatacctatgccatgatctgggtccgtcaggccccaggggaagggctggagtgggtctcatccattacnggtggtagtgccanaaatgtcgcagactccgtgaaggccgcttcatccgtctccaggacaattccaagatacggtgttctgcagatgaaagngcctgcgagtggacgacacggccctttaatacctgtcgcctaggacgggttcgcgaagaacgttaacaacaaataacaaagttattaactactaaacagtacggaacgttcgtagggggacgaaaacgggggtcccccggttacgaacccggttccgtcccgttccaacggcccctacccgaacccgaaacggggccccc

SEQ ID NO: 397406 - DNA, 498 bp, Homo sapiens
  misc_feature: GZ8MTXP02GVBO3.44.71.G05.1.454.CMB.2.raw
  modified_base (300)..(300): a, c, t, g, unknown or other
  modified_base (418)..(418): a, c, t, g, unknown or other
  modified_base (422)..(422): a, c, t, g, unknown or other
  modified_base (424)..(424): a, c, t, g, unknown or other
  modified_base (445)..(445): a, c, t, g, unknown or other
tcagacagtatatacacgaccggtgctcgatttagtgtcgtcgcaagagagagggggatctcaggaggcagctctctcggaatatctccaccatggcctgggctctgctcctcctcaccctcctcactcagggcacaggatcctgggctcagtctgccctggctcagcctcctccgtgtccggtctcctggacagtcagtcaccatctcctgcactggaaccaacagtgacgtcggtcgttttgaccgtgtctcctggtaccagcacgaccccagaaacacgaccccaaatcattattangcgtacaatgttcgcccttccggtgtccctgagcgcttcctcgtggtccaagtctggcacacggcctcctgaccatctctggctcgagctgagacgaggctgattatactgcagctanatananagtagactacttacagtcgcncgacggacagctacgaccgtcgtacgcacgccgagcctcgccctcgtcactcg

SEQ ID NO: 397407 - DNA, 520 bp, Homo sapiens
  misc_feature: GZ8MTXP02FXARQ.44.71.G05.1.454.CMB.2.raw
  modified_base (284)..(284): a, c, t, g, unknown or other
  modified_base (304)..(304): a, c, t, g, unknown or other
  modified_base (309)..(309): a, c, t, g, unknown or other
  modified_base (315)..(315): a, c, t, g, unknown or other
  modified_base (323)..(323): a, c, t, g, unknown or other
  modified_base (329)..(329): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaacncgaccccaaatcattattangcgtnatgtcncccttcgntcctgngcgtcttcctcgtggtcagtctgcacgcgcctcctgaccatctcgtggcctcgagctgaggacgaggctagattactactgcagctcatatacaagtggaactactttacagttcgcgacgacggtaccaagtctacgtaccgtcgtacggtcacgcccgaaggcctccgcccccgtcggtccacttcccg

SEQ ID NO: 397408 - DNA, 548 bp, Homo sapiens
  misc_feature: GZ8MTXP02GBCM2.44.71.G05.1.454.CMB.2.raw
  modified_base (354)..(354): a, c, t, g, unknown or other
  modified_base (381)..(381): a, c, t, g, unknown or other
  modified_base (394)..(394): a, c, t, g, unknown or other
  modified_base (404)..(404): a, c, t, g, unknown or other
  modified_base (413)..(413): a, c, t, g, unknown or other
  modified_base (445)..(445): a, c, t, g, unknown or other
  modified_base (474)..(474): a, c, t, g, unknown or other
  modified_base (481)..(481): a, c, t, g, unknown or other
  modified_base (495)..(495): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacgagccagggcggtctctgagactctcctgtgtagtctcaggattcagtcttagtgattatcacttggcctggggtcccgtcgaggcctccgaggggaggggcttggagtggatcactttcgcagtaatgaaacgttntggtaggaagtaaagagtacgcgcgtntgtaggagggganattcaccgtnacgaagggntgactccaagagtgttgcctattacaaatgancaaactgacgacccgagacacgagccgtntattacngcgcaggcatccgnggactgatcgctagtttgaattaggttcggggaccaggggactagtcggtacc

SEQ ID NO: 397409 - DNA, 583 bp, Homo sapiens
  misc_feature: GZ8MTXP02ISF46.44.71.G05.1.454.CMB.2.raw
  modified_base (459)..(459): a, c, t, g, unknown or other
  modified_base (499)..(499): a, c, t, g, unknown or other
  modified_base (503)..(503): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcgggaggtcgggggggggcttgggcacgagccagggcggtctctgagactctcctgtgtagtctcaggattcagtcttagtgattatcacttggcctgggtcctcgaggctccgaggggaggggcttggagtggatcactttcgcagaatgaaaacgttgtggtaggaaagtaaagagtaccgccgcgtctggtagaggggaatattcgaccgttctacgaaaggggtatgacctaccgaaatagtgttcggcctaatttaacaaatgancaaacctgaacgacccgagacacgaggcctactagttacngccnccgaggcctatcccgtggggaccttcgattcgctagtttgaatacggtttgggggaccaaggggacctaagttcggtacc

SEQ ID NO: 397410 - DNA, 515 bp, Homo sapiens
  misc_feature: GZ8MTXP02JTTOT.44.71.G05.1.454.CMB.2.raw
  modified_base (323)..(323): a, c, t, g, unknown or other
  modified_base (359)..(359): a, c, t, g, unknown or other
  modified_base (379)..(379): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccaacagtgacgtcggtctttgaccgtgtctctggtaccagcagaccccagaaacacgacccccaaatcattatttatgcgtcaatgttcgcccttcggtntccctgagcgcttcctctgggtccaagtctggcacncggcctccctgaccatctcnggctcgagctgagacgaggctgattatactgcagctcatatacgaagtggaaactctttaacatttcggcgacgtacgggaccaagcgtacgaccgtctacggtcacgccaaggctacgcccctcggtcacgtccg

SEQ ID NO: 397411 - DNA, 556 bp, Homo sapiens
  misc_feature: GZ8MTXP02IWU3T.44.71.G05.1.454.CMB.2.raw
  modified_base (270)..(270): a, c, t, g, unknown or other
  modified_base (371)..(371): a, c, t, g, unknown or other
  modified_base (384)..(384): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacagccaggggcggtctctgagactctcctgtgtagtctcaggattcagtcttagngattatcacttggcctgggtcctcaggctccgaggggaggggcttggagtggatcactttcgcagaatgaaacgttatgggtagaagtaaagagtacgcgngtctgtgaggganattcaccgtctacgaagggatgactccaaacaggtgttggacctatttaacaaatgagcaaactgaacgacccgacgaccacgaggcgtactattacacgcgccgaggcgatccgtggggactcggatcgacatttgaattagttcggggacctaggggacaagtcggtacc

SEQ ID NO: 397412 - DNA, 549 bp, Homo sapiens
  misc_feature: GZ8MTXP02F0105.44.71.G05.1.454.CMB.2.raw
  modified_base (346)..(346): a, c, t, g, unknown or other
  modified_base (386)..(386): a, c, t, g, unknown or other
  modified_base (396)..(396): a, c, t, g, unknown or other
  modified_base (404)..(404): a, c, t, g, unknown or other
  modified_base (413)..(413): a, c, t, g, unknown or other
  modified_base (430)..(430): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactgggcggaggtcggggggggcttgggcacagccaggggcggtctctgagactctcctgtgtagtctcaggattcagtcttagtgattatcacttggcctgggtccgtcaggctccgagggaaggggcttggagtggatcactttcgcagatgaaacgttntggtaggaagtaaagagtacgccgcgtctgtagagggganattcaccgtntcaagggntgactcaangtgtgcattacaatgancaaccgtgagacccgagacacgagcgtctattactgccgaccgaggcgactcccgtggggacctcggattcggactattttggaatttagttcgggggccagggggacaagtcggtacc

SEQ ID NO: 397413 - DNA, 532 bp, Homo sapiens
  misc_feature: GZ8MTXP02G3A6C.44.71.G05.1.454.CMB.2.raw
  modified_base (342)..(342): a, c, t, g, unknown or other
  modified_base (397)..(397): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcggggggggcttggcacagccagggcggtctctgagactctcctgtgtagtctcaggattcagtcttagtgattatcacttggcctgggtccgtcaggctccagggaggggcttgagtggatcactttcgcagaatgaaacgttanggtggaagtaaagagtacgcgcgtctgtgagggagattcaccgtctcaaaggggntgactccaacagtgttgccatttacaaatgagcaaacctgacgacccgacgacacaggcgtctatactgcgccaggcatccgtgggacgtcgatcgcatttgaattagttggggaccaggggtacaagtggtacc

SEQ ID NO: 397414 - DNA, 585 bp, Homo sapiens
  misc_feature: GZ8MTXP02GL9EP.44.71.G05.1.454.CMB.2.raw
  modified_base (291)..(291): a, c, t, g, unknown or other
  modified_base (391)..(391): a, c, t, g, unknown or other
  modified_base (411)..(411): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcggggggggcttgggcacagccagggcggtctctgagactctcctgtgtagtctcaggattcagtcttagtgattatcacttggcctgggtcctnaggctccagggagggcttggagtggatcactttcgtcagaatgaaacgttatggtaggaagtaaagagtacgccgcgtctgtggagggagattcaccgtntcgaagggatgactaccaanagtgtgcctattacaaatgagcaacctgacgacccgagacacgaggctactattactcgcgaccgaggccgaacgtcccgtagggggaccgttacggacgttcggactagttttaggaatttaaggtttcggggggacccgtaaggggggaacctaaaggtcggggttaacccg

SEQ ID NO: 397415 - DNA, 581 bp, Homo sapiens
  misc_feature: GZ8MTXP02JA9XU.44.71.G05.1.454.CMB.2.raw
  modified_base (429)..(429): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaaccacgacccccaaactcaattatttatgcggtcaatgttccgcccttccggtctcccctgacgcgtcttcctcgtcgggtccaagtctcggcacgccggcctccctcgacctatcctcgtcgggccttcccgaggctaggaggacgnggctggaacttatacgtgcagtctacatataacaagtaggaactactttactagttcggcgcgtaacggggaccaaaggcctacgacccgttacgttacggccaacgaaccccgaagggtcctccggcccccgtacggtcctaccgtttccg

SEQ ID NO: 397416 - DNA, 534 bp, Homo sapiens
  misc_feature: GZ8MTXP02H9X1F.44.71.G05.1.454.CMB.2.raw
  modified_base (229)..(229): a, c, t, g, unknown or other
  modified_base (309)..(309): a, c, t, g, unknown or other
  modified_base (395)..(395): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagccctccctccgtgtcccggtctcctggacagtcagtcaccatctcctgcactggaaccanagtgacgtcggttcgtttcgaccgtgtctcctggtaccagcacgaccccagaaaccacgacccccaaactcattatttangcgtcaatcgttcgtcccttccggtgtccctgacgcgtcttcctcgtcgggtccaagtctggcacacggcctccctgaccatctcngggcctccgagctgagacgaggctgattatactgcagcttacatactaacgaagtggaacttacgtttaactagttcgcgacgacggaccaagctacgaccgtctaggtcacgccaggcctcgcccctcggtcacttcg

SEQ ID NO: 397417 - DNA, 555 bp, Homo sapiens
  misc_feature: GZ8MTXP02GYRRO.44.71.G05.1.454.CMB.2.raw
  modified_base (300)..(300): a, c, t, g, unknown or other
  modified_base (312)..(312): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgcgtccggtctcctggacagtcagtcacatctcctgcactggaaccacagtgacgtcggtcgttttgaccgtgtctcctggtaccagcacgaccccagaaacacgaccccaaatcattattangcgtcaatgtcncccttcgtgtccctgacgcgtcttcctcgtggtccagtctgacacgcgcctcctgaccatctcgtggctcgagctggaggacgaggctagattatactgcagcttacattactaacgaagtacgggaaactacgtttactagttcggcgacgaagggacccaagcctacggaccgttacccgtaggtccaacggaacccgaaacggtcctaccgccccccttacgggtccctacgtttccccg

SEQ ID NO: 397418 - DNA, 614 bp, Homo sapiens
  misc_feature: GZ8MTXP02F78NG.44.71.G05.1.454.CMB.2.raw
  modified_base (311)..(311): a, c, t, g, unknown or other
  modified_base (337)..(337): a, c, t, g, unknown or other
tcagacagtatatacacgaccggtgctcgatttagtgtcgtcgcaagagagaggagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggttcgtttgaccgtgtctcctggtaccagcacgaccccagaaaccacgacccccaaatcaattatttangcgtacaatgttccgcccttccggtntcccctgacgtcgtcctttctcgtcgggtacctaaggttcctcgggccaaaccgacccgggtccccttcccccgtagaacccctattccctcgtcggggcctcccgaggcctgacggacgaggctagtattagttactgacagctacaataataacgaaggttacggaaacttaactttacaagttcggcgacgaacgggaccaaagccgtacggacccgttacgtacggtaccaacgccccaaaggccctacccgtcccccgtcggtacctacccg

SEQ ID NO: 397419 - DNA, 600 bp, Homo sapiens
  misc_feature: GZ8MTXP02IFU1T.44.71.G05.1.454.CMB.2.raw
  modified_base (227)..(227): a, c, t, g, unknown or other
  modified_base (257)..(257): a, c, t, g, unknown or other
  modified_base (280)..(280): a, c, t, g, unknown or other
  modified_base (301)..(301): a, c, t, g, unknown or other
  modified_base (308)..(308): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctctcactcagggcacaggatcctgggctcagtctgccctggctcagcctcctccgtgtccggtctcctggacagtcagtcaccatctcctgcactggaaaccaangtgacgttcggtcgttttgacgtgtctccnggtaccagcacgacccagaaacncgaccccaaatcattattagngacgtanatcgtccgtccgttcgtctcctgacgtcgtcttccgtcgtcgtactacgtcgtacgacacgaccgtcctccgtacgacctactctcgtcggtacctccgacgcgtacggacggacggacgtacgtagtaagttacgttacgtacgacgactactactaataacgtaaacgtaagtaacggtaaacgttaacgtttaacgttaacgtacgtacgacgaacggaacgaacgacgtacgtaccgtaccgtacgtacgacgaaccgacgacgtccgcccgtccgtaccgtactccg

SEQ ID NO: 397420 - DNA, 738 bp, Homo sapiens
  misc_feature: GZ8MTXP02I334O.44.71.G05.1.454.CMB.2.raw
  modified_base (351)..(351): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactgggcgggaggtcggggggggggcttgggcacagccaggggcggtctctgagactctcctgtgtagtctcaggattcagtcttagtgattatcacttggcctgggtccctcgaggctccgaggggagggcttggagtggatctactttcgtcagatgaaacgttntgggtaggaagtaaagagtacgccgacgtctggtaggagggggaatacgtttaccgacccgttctacggaaaagggggtacttaggaacccttacccgaaaacgtaggttcggtttacgggacccttaagtttttaaaccaaaagtttcggaaacggtaccaaaacccgttagggaaaccggtaccccccggaaggaaacccacgggaaacgggtcccgttacttaaagtttaccgacggcccggtacccgaaggggtccgtaacgttccccggtagggggaacccgtttccggaacgttcgggtaccctaagtttttcggaaagttttacggttttacggggggaccccgtaaggggggaacctaacgggtttcggggttaccccg

SEQ ID NO: 397421 - DNA, 557 bp, Homo sapiens
  misc_feature: GZ8MTXP02F3XK4.44.71.G05.1.454.CMB.2.raw
  modified_base (353)..(353): a, c, t, g, unknown or other
  modified_base (394)..(394): a, c, t, g, unknown or other
  modified_base (405)..(405): a, c, t, g, unknown or other
  modified_base (491)..(491): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcgggaggtcggggggggggcttgggcacgagccagggcggtctctgagactctcctgtgtagtctcaggattcagtcttagtgattatcacttggcctggggtcctcaggctccgaggggaggggcttggagtggatcactttcgcagaatggaaaacgttntggtaggaaagtaaagagtacgcgcgtctggtgaagggganattcaaccgtntacgaaaggggatgactccaaacagtgttggaccatttacaaaatgaagcaaacctgaacgacccgacgacacaggctctattacngcgccaggcatccgtgggactcgatgactatttgaatagtttcggggctaggggacaagtggtacc

SEQ ID NO: 397422 - DNA, 627 bp, Homo sapiens
  misc_feature: GZ8MTXP02F8CPR.44.71.G05.1.454.CMB.2.raw
  modified_base (356)..(356): a, c, t, g, unknown or other
  modified_base (367)..(367): a, c, t, g, unknown or other
tcagacagtatatacacgaccggtgctcgatttagtgtcgtcgcaagagagagggggggagtctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccacgaaacacgcccccaaactcattatttatgcggtcaatgttccgcccttccggtgtccctgagcgtccttccttcgngggtcaacgtntggcacacggccctcctcgaccatctcctgggcctccaggcgtgagggacgaggctagtattacttacttggccagtccttcaattaagtaacccgaaaggttacggggaaacttaacctttttaacgtacgtttcggggcccggactaacgggggaaccccctaaaggcccgttagtaaccccggtccttaaacggggtccaacggaaccccgaacggtaccgttcccggtcccccctaccgggtccctaaccttcccg

SEQ ID NO: 397423 - DNA, 544 bp, Homo sapiens
  misc_feature: GZ8MTXP02J1VAR.44.71.G05.1.454.CMB.2.raw
  modified_base (373)..(373): a, c, t, g, unknown or other
  modified_base (377)..(377): a, c, t, g, unknown or other
  modified_base (386)..(386): a, c, t, g, unknown or other
  modified_base (404)..(404): a, c, t, g, unknown or other
  modified_base (512)..(512): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactgggcggaggtcggggggggcttggcacagccaggggcggtctctgagactctcctgtgtagtctcaggattcagtcttagtgattatcacttggcctgggtcccgtcaggctccgaggggaaggggcttggagtggatcactttcgtcagaatgaaacgttatggtggaagtaaagagtacgccgngtcngtgaggganattcacgtctcaaagggntgactccaacagtgtgcatttacaaatgagacaacctgacgacccgacgacacgaggtcgtctatactgccgccaggcgactccgtagggacgtcgatcgctatttgnttagtttcggggcctaggggacaagtcggtac

SEQ ID NO: 397424 - DNA, 581 bp, Homo sapiens
  misc_feature: GZ8MTXP02HXY8A.44.71.G05.1.454.CMB.2.raw
  modified_base (274)..(274): a, c, t, g, unknown or other
  modified_base (379)..(379): a, c, t, g, unknown or other
  modified_base (389)..(389): a, c, t, g, unknown or other
  modified_base (397)..(397): a, c, t, g, unknown or other
  modified_base (406)..(406): a, c, t, g, unknown or other
  modified_base (416)..(416): a, c, t, g, unknown or other
  modified_base (437)..(437): a, c, t, g, unknown or other
  modified_base (477)..(477): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgagggcgactggcgggaggtcggggggggggcttgggcacgaggccgagggcggtctcgtgagactctcctgtgtagtctcaggattcagtcttagngtattatcacttggcctgggtccgtcgaggctccgaggggaagggcttggagtggatcactttcgcagaatgaaacgttatggtagaagtaagagtacgcgagtntgtgaggganatcacgtntcgaagggntgactccaanagtgtgactattacaaatganacaactgacgacccgagacacgaggtacgtactattacgngaccgaccgaggcgacgtcccgtggggacctcggaatcggacttagttttaggaagtttaagggtttcgggggaccgtaagggggtacaaagtttcgggacccg

SEQ ID NO: 397425 - DNA, 505 bp, Homo sapiens
  misc_feature: GZ8MTXP02JML9K.44.71.G05.1.454.CMB.2.raw
  modified_base (417)..(417): a, c, t, g, unknown or other
  modified_base (421)..(421): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcaggcacaggatcctgggctcagtctgccctggctcagcctccctccgtgtccggtctcctggacagtcagtcaccatctcctgcactggaaccaacagtgacgtcggtcgttttgaccgtgtctcctggtaccagcagaccccagaaacagccccaaatcatatttatgcgtcaaatgttcgcccttcggtgtccctgagcgcttctctgggtccaaagtctggcacacggcctccctgaccatctctgggctccaggctgagacaggctgattatactgcagctanatanagaagtgaactacttatagtcgcgacgacggacaagctagaccgtctacgtcacgaaccgaacgtctcgcccgtccgtctactc

SEQ ID NO: 397426 - DNA, 560 bp, Homo sapiens
  misc_feature: GZ8MTXP02J29UH.44.71.G05.1.454.CMB.2.raw
  modified_base (384)..(384): a, c, t, g, unknown or other
  modified_base (395)..(395): a, c, t, g, unknown or other
  modified_base (416)..(417): a, c, t, g, unknown or other
  modified_base (501)..(501): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacagccgagggcggtctctgagactctcctgtgtagtctcaggattcagtcttagtgattatcacttggccctggggtccgtcaggcctccgaggggaaggggcttggagtggatcactttcgtcagaatgaaacgttatgggtggaaagtaaagagtacgccgcgtcnggtgagggganattcaccgtctacgaaagggnngactccaacagtgtgctattacaaatgagcaacctgacgacccgagaccacgaggcgtacttatactgccgccagggcatccgngggacgtcgatcgctagtttcgaagttagtttcggggcctaggggaccaagtcggtacc

SEQ ID NO: 397427 - DNA, 530 bp, Homo sapiens
  misc_feature: GZ8MTXP02F4SKH.44.71.G05.1.454.CMB.2.raw
  modified_base (365)..(365): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatcctcctgcactggaaccaacagtgacgtcggtcgttttgaccgtgtctcctggtaccagcacgaccccagaaacacgcccccaaactcattatttatgcgtcaatgttcgcccttcggtgtccctgagcgcttcctcgtggtccaagtctggcacncgcctcctgaccatctctgggcctccaggctgaggacgaggctgattatactgctagctcatatacaagttgggaaactacgtttactagttcggcgcgaagggacccaagctacgaccgtaccgtaggtccacgcccaaggcctcgccccctcggccacttccg

SEQ ID NO: 397428 - DNA, 579 bp, Homo sapiens
  misc_feature: GZ8MTXP02H3FAC.44.71.G05.1.454.CMB.2.raw
  modified_base (301)..(301): a, c, t, g, unknown or other
  modified_base (307)..(307): a, c, t, g, unknown or other
  modified_base (318)..(318): a, c, t, g, unknown or other
  modified_base (328)..(328): a, c, t, g, unknown or other
  modified_base (444)..(444): a, c, t, g, unknown or other
  modified_base (453)..(453): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcacgccctcctccgtgtccggtctcctggacagtcagtcacatctctgcactggaaaccacagtgacgtcggtcgtttgaccgtgtctcctggtaccagcacgacccagaaacacgaccccaaatcattacttangcgtanaattcgttccncccttcggtntccctgacgtcgtcttctcgtacgggtacaagttctcggacacgaccgtcctcccccgtagaccctactcttcgcggcctccgaggcctaggacgacgaggctagtatttatacgngacatctanaatataacgtaaagtacgtaaacttacgttaactacgtacgacgtacgacggaactacgtcgtacgaccgtacgtacgtaccacgaacccgtaacggcccgtcccgcccgtccgtacctaccgtcg

SEQ ID NO: 397429 - DNA, 546 bp, Homo sapiens
  misc_feature: GZ8MTXP02F7OIX.44.71.G05.1.454.CMB.2.raw
tcagacagtatatacacgaccggtgctcgatttagtgtcgtcgcaagagagaggggggatctcaggaggcagctctctcggaatatctccaccatggcctgggctctgctcctcctcaccctcctcactcaggacacagggtcctgggcccagtctgccctgactcagcctccctccgcgtccgggtctgtcggtcagtcagtcaccatctcctgcactggcaccagcagtgacattggtgttataactttgtctcctggtaccaacaccacccaggcaaacgcccccaaattcatcatttatgatgtcagtaagcggccctcgaggggtccctgatccgcttctctggctccaagtctggcaacaccgcctccctgacccgtctccgtgggcctccgaggctggacggatgaggctgaccttatttctgctcctcatatgcaggcgtactagggttttatcgttcttacgggaacgttcggggaacctaagggtccaacccgttcctaacggtcacgacccgaacggccccaacccactcgtacc

SEQ ID NO: 397430 - DNA, 597 bp, Homo sapiens
  misc_feature: GZ8MTXP02HBCZY.44.71.G05.1.454.CMB.2.raw
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccaacagtgacgtcggtcgtttgaccgtgtctctggtaccagcacgaccccagaaaccacgacccccaaactcattatttatcgcgtacaatcgttcgtcccttcggtctccctgacgcgtcttccctcgtcggtaccaagtctggacacgccggcctccctgaccatcctcgtcggctccgaggctggacgacgacggtctgtattattactgcacgctacattactaactaaagtacgggtaaactactttaacgttacgttcggacgtacgtaacgggaacctacgcgtacgacccgttaccgtaacggtccgaaccgcccgaaacggtcccgtcccggtacccccccggtctacccgttccgtttccccg

SEQ ID NO: 397431 - DNA, 604 bp, Homo sapiens
  misc_feature: GZ8MTXP02HP8BJ.44.71.G05.1.454.CMB.2.raw
  modified_base (261)..(261): a, c, t, g, unknown or other
  modified_base (301)..(301): a, c, t, g, unknown or other
  modified_base (326)..(326): a, c, t, g, unknown or other
  modified_base (376)..(376): a, c, t, g, unknown or other
  modified_base (405)..(405): a, c, t, g, unknown or other
  modified_base (478)..(478): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtcagtgtgaagtgcagctgttggaggtcggggggaggcttggtacaggccgggggcgtccctgacactctcctgtgcagcctctggattcaccatcagtgaccactatatggactggggtccnccaggcctccgagggaaggggctgggagtggcttggccgnaagtaaaaacaagttgccagcttancacagagtacgcgctctgagaaagccccaagtacttcacctctacaaagngtatgacttacaaagactcattgatttcngactaatgaacttaaacccgagaaaaaccgaggacctacgggcaattgtatttagttgtgttgttagtttaanacgtacgaagtaactcgtaccgtacggtcggggacccgaaggggtaaccctcgggtaccctaccgttcctcccgtacgaaccgtaccctacccgaaaccgaaccggccctacggttcccgttcccg

SEQ ID NO: 397432 - DNA, 552 bp, Homo sapiens
  misc_feature: GZ8MTXP02F64DD.44.71.G05.1.454.CMB.2.raw
  modified_base (344)..(344): a, c, t, g, unknown or other
  modified_base (382)..(382): a, c, t, g, unknown or other
  modified_base (428)..(428): a, c, t, g, unknown or other
  modified_base (522)..(522): a, c, t, g, unknown or other
  modified_base (533)..(533): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtccagtgtgaagtgcagctgttggagtcggggggaggcttggtacaggccgggggggtccctgacactctcctgtgcagcctctggattcgcctttaatacctatgccatgatctgggtcctcacggccccagggaggggctggagtgggtctcatccattactggtggtagtgccaacaaatgtcgcagactccgtgaagggccncttcatcgtcctccgaggacaattccaagtaatcggtnttctgcagatgaagagctgcgagtggacgacacggtcctttatacngtgcctaggaggtcacgagtaagttacaaacaatacaagtacttacaactacagttacggacgtctggggacaaacgggccccgtacacccgtncctcacgtccnccgaaccgtacggcctacg

SEQ ID NO: 397433 - DNA, 566 bp, Homo sapiens
  misc_feature: GZ8MTXP02J12QT.44.71.G05.1.454.CMB.2.raw
  modified_base (235)..(235): a, c, t, g, unknown or other
  modified_base (345)..(345): a, c, t, g, unknown or other
  modified_base (383)..(383): a, c, t, g, unknown or other
  modified_base (541)..(541): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggctgttttaaaaggtgtccagtgtgaagtgcagctgttggagtcgggggaggcttggtacagccggggggtccctgacactctcctgtgcagcctctggattcgcctttaanacctatgccatgatctgggtcctcaggccccaggggaaggggctgggagtgggtctcgatccattactggtggtagtgccacaaatgtcgcagactccgtgaacgggccnctcatccgtcctccagggacaattccaagactacggtntttctgcagatgaagagctgcgaggtgacgacacggtccctttagtactgtgccgaggacggggtcacaaggaaagttaacaaactaaataacgaattaacttactaactactagtggacgtcggtaggggacaacggggaccccgtcaccgtctccncacgccctaccgaaccgacggaccc

SEQ ID NO: 397434 - DNA, 581 bp, Homo sapiens
  misc_feature: GZ8MTXP02GEERT.44.71.G05.1.454.CMB.2.raw
  modified_base (190)..(190): a, c, t, g, unknown or other
  modified_base (224)..(224): a, c, t, g, unknown or other
  modified_base (235)..(235): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggacacagggtcctgggcccagtctgccctgactcagcctgcctccgtgtctgggtcncctggacaggtcgtcaccatctcctgcactgganccagcgtaatnttcttagtcttaactttgtctcctggtatcaacatcatccaggtaaacgccccaaactcatcatctatgagctataagacgcctgaggggtttctaatccgcttcactcgcctccaagtcccgacaacgaccggccctccctagaacctaatcctcgtcgggcctcgaggctgacggacgaggctagatttattattgttgctcagtatgttcgtcgctactctaatttgtcgttacgttacgggaaaggttacgggaaccgtaaggttacccgacccgttacgttaacgggtccgaaccggaccccgaaacggacccccaaacccccgtactacgttaacccccg

SEQ ID NO: 397435 - DNA, 542 bp, Homo sapiens
  misc_feature: GZ8MTXP02JJA0V.44.71.G05.1.454.CMB.2.raw
  modified_base (307)..(307): a, c, t, g, unknown or other
  modified_base (312)..(312): a, c, t, g, unknown or other
  modified_base (360)..(360): a, c, t, g, unknown or other
  modified_base (443)..(443): a, c, t, g, unknown or other
  modified_base (447)..(447): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaccaacagtgacgtcggtcgttttgaccgtgtctcctggtaccagcacgaccccagaaaccacgaccccaaactcattattangcgtnatgtcgcccttcggtcgtccctgacgcgtcttcctctggtccaagtcnggacaccgaccggcctcccgtgaccctagtcctcgtcgggcctcccgaggctggaggacgaggctagattattactgcagctnatanacagtaggaactactttacagttcgacgcgaacgggtaccaagctagaccgtctaggtccacgcccgaagcctccgcccctcggtccacgtcccg

SEQ ID NO: 397436 - DNA, 600 bp, Homo sapiens
  misc_feature: GZ8MTXP02GVITK.44.71.G05.1.454.CMB.2.raw
  modified_base (229)..(229): a, c, t, g, unknown or other
  modified_base (304)..(304): a, c, t, g, unknown or other
  modified_base (328)..(328): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaanagtgacgtcggtcgtttgaccgtgtctctggtaccagcacgaccccagaaacacgaccccaaactcattatttangcgtcaatgttccgcccttcggtntccctgacgcgtcttcctcgtcggtccaagtctggacacgaccgcctcctgaccatctcgtcggcctccgagctgaggacgaggctagatttactactgcagcttacaattactaacgaaaggttacgggaaaacttacgttttaactacgttccgggacgtacggaacggggaacctaaaggccgttacggaacccgttaccgtaacgggtccaacggaaccccgaaagggtccctccgtaccccccgtcggttaccctaccgtttccccg

SEQ ID NO: 397437 - DNA, 563 bp, Homo sapiens
  misc_feature: GZ8MTXP02JSGNO.44.71.G05.1.454.CMB.2.raw
  modified_base (278)..(278): a, c, t, g, unknown or other
  modified_base (363)..(363): a, c, t, g, unknown or other
  modified_base (371)..(371): a, c, t, g, unknown or other
  modified_base (377)..(377): a, c, t, g, unknown or other
  modified_base (384)..(384): a, c, t, g, unknown or other
  modified_base (394)..(394): a, c, t, g, unknown or other
  modified_base (404)..(404): a, c, t, g, unknown or other
  modified_base (414)..(414): a, c, t, g, unknown or other
  modified_base (475)..(475): a, c, t, g, unknown or other
  modified_base (498)..(498): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcggggggggggcttgggcacagccgaggggcggtctctgagactctcctgtgtagtctcaggattcagtcttagtgattancacttggcctgggtccgtcaggctccgagggagggcttgagtggatcactttcgcagaatgaaacgttatgggtagaagtaaagngtacgcgngtctgngaggganattcgacgtntacgaagggntgactccaangtgttgctattacaaatgagacaactgaacgacccgagacacgaggcgtactagttaccgngccgacgaggacgtacgtccggngggacgtcgatcgacttagttgaagttaggttcgggggaccgaaggggtactacggtcggtaccg

SEQ ID NO: 397438 - DNA, 640 bp, Homo sapiens
  misc_feature: GZ8MTXP02I1UEK.44.71.G05.1.454.CMB.2.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctcctggtaccagcacgaccccagaaacacgacccccaaactcattatttatgcgtcaatgtcgtcccttcggtctccctgagcgtcttcctcgtggtccaagtctggcacgccgcctccctgaccatcctcgtcgggcttcccgaggcctaggacggacggaggcctagaatttacttaactgacacgcttaccattaagtaaccgaaaggttcgggaaaccttacgtttaacttacgttcggacgtaccgtaaaggggacccctaaaaggtcccgtaacggaccccggttaccgtaaacggggttccaaaccgggaacccccgtaaaagggggtcccttaccccgggcccccccgttacgggtacccctaaccgttttccccg

SEQ ID NO: 397439 - DNA, 524 bp, Homo sapiens
  misc_feature: GZ8MTXP02FKQBS.44.71.G05.1.454.CMB.2.raw
  modified_base (450)..(450): a, c, t, g, unknown or other
  modified_base (467)..(467): a, c, t, g, unknown or other
  modified_base (478)..(478): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaaccaacagtgacgtcggtcgttttgaccgtgtctcctggtaccagcacgaccccagaaacacgacccccaaaatcaattattatgcgtacaatgttccgccccttccggtgtcccctgagccgtcttccctcgtcggggtccaagtctggacaccgaccggccctcccgtgacccatcctcgtgggcctccaggctggaggacgaggctagattagtctgcagctnatatacaagtggaactntttacatcgcncacggacagctgacctctagcagccgagctcgcccctgccactccg

SEQ ID NO: 397440 - DNA, 629 bp, Homo sapiens
  misc_feature: GZ8MTXP02HAPEM.44.71.G05.1.454.CMB.2.raw
  modified_base (230)..(230): a, c, t, g, unknown or other
  modified_base (305)..(305): a, c, t, g, unknown or other
  modified_base (332)..(332): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcaggcacaggatcctgggctcagtctgccctggctcagcctccctccgtgtccgggtctcctggacagtcagtcaccatcctcctgcactggaaccaanagtgacgtcggtcgtttgaccgtgtctcctgtaccagcacgaccccagaaacacgaccccaaactcattattacngcgtacaatcgttccgcccttccggtntccctgacgcgtcttccgtcgtcggtacaagtctggacacgccgccctccctagacctactcctccgtcgggcctcccgaggtcgtacggaaggtacgaggcttagtatttacgtacgtgctaagccttacaattactaaacgtaaggtacggaaaccttaagttttactagttccggacgacgtaaacgggaccaaaggtcctacggtaaacccgtccgtaaacggtcccaaccggtaacccgaaaggtccccgttaccggtacccccccgtcggtaacccctaccgtttcccccg

SEQ ID NO: 397441 - DNA, 498 bp, Homo sapiens
  misc_feature: GZ8MTXP02F8LAF.44.71.G05.1.454.CMB.2.raw
  modified_base (299)..(299): a, c, t, g, unknown or other
  modified_base (311)..(311): a, c, t, g, unknown or other
  modified_base (319)..(319): a, c, t, g, unknown or other
  modified_base (327)..(327): a, c, t, g, unknown or other
  modified_base (346)..(346): a, c, t, g, unknown or other
  modified_base (352)..(352): a, c, t, g, unknown or other
  modified_base (368)..(368): a, c, t, g, unknown or other
  modified_base (410)..(410): a, c, t, g, unknown or other
  modified_base (414)..(414): a, c, t, g, unknown or other
  modified_base (416)..(416): a, c, t, g, unknown or other
  modified_base (431)..(431): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctcctgcactggaaccaacagtgacgtcggtcgttttgaccgtgtctctggtaccagcagaccccagaaacacgccccaaatcattattangcgtcaatgtcncccttcgntccctgancgctctctggtccaagtcnggcacncgcctcctgaccatcnctggcctcaggctgaggacaggctagattatactgcagctanatananaagtgaactacttanagtcgcgacgacggacagctacgaccgtcgtacgcacgaaccgacgctccgcccgtcgacctactcg

SEQ ID NO: 397442 - DNA, 564 bp, Homo sapiens
  misc_feature: GZ8MTXP02GSJZF.44.71.G05.1.454.CMB.2.raw
  modified_base (429)..(429): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccacagtgacgtcggtcgtttgaccgtgtctctgtaccagcacgaccccagaaacacgccccaaactcattatttatgcgtcaatcgtccgcccttcggtctccctgacgcgtcttcccgtctgggtccaagtctggaccacgccggccctcctgacccatcctctcgggcctcccgagctggaggacgaggctgtatttatacgngcagctacatataacgaagtacggaaacttacgtttaactagttccggacgacgtacgggaccaagcgtacgacccgtaccgtaggtaccacgaacccgaacggcgtcccggtacccccgtcggtcccacttccc

SEQ ID NO: 397443 - DNA, 596 bp, Homo sapiens
  misc_feature: GZ8MTXP02GLME7.44.71.G05.1.454.CMB.2.raw
  modified_base (307)..(307): a, c, t, g, unknown or other
  modified_base (324)..(324): a, c, t, g, unknown or other
  modified_base (408)..(408): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatcctgggctcagtctgccctggctcagcctccctccgtgtccggtctcctggacagtcagtcaccatctcctgcactggaaaccacagtgacgtcggtcgttttgaccgtgtctcctggtaccagcagaccccagaaaccacgaccccaaatcattattatgcgtnatgttcgcccttcggtntcccctgagccgtctttcctcgtggtccaagtctggcacgccggcctccctgaccatctcgtggccttccgaggctgaggacgnggctgattattacgtgacagctacatatacgaagtgggaaacctacgtttaactagttccggacgacgtaacggggaaccctaaggccgttacggaaaccccgttccgtaaacgggtcccaacggaaccccccgtaaagggtcccgttaccccgacccccccgttagggtcccctacctttccccggg

SEQ ID NO: 397444 - DNA, 589 bp, Homo sapiens
  misc_feature: GZ8MTXP02GXXBW.44.71.G05.1.454.CMB.2.raw
  modified_base (282)..(282): a, c, t, g, unknown or other
  modified_base (304)..(304): a, c, t, g, unknown or other
  modified_base (310)..(310): a, c, t, g, unknown or other
  modified_base (379)..(379): a, c, t, g, unknown or other
  modified_base (384)..(384): a, c, t, g, unknown or other
  modified_base (447)..(447): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatcctgggctcagtctgccctggctcagcctccctccgtgtccggtctcctggacagtcagtcaccatctcctgcactggaaccaacagtgacgttcggtcgtttgaccgtgtctctggtaccagcacgaccccagaaaccncgaccccaaatctattatttangcgtanaatgttccgcccttcggtctcccctgacgtcgtcttccgtcgtggtccagtctggacacgccgcctccngaccntctcgtggcctccgaggcctggacggtacgaggtctagtattactacgtgcagtctacattanacgaaggtacggtaactactttaccgtagttccgggacgtaacgaacgggtaaaccaaggtcccttacggaacccgttccgtaaggtccaacgtaacccgaacggtccctacccgcccccgttacggtaccctactttcccg

SEQ ID NO: 397445 - DNA, 558 bp, Homo sapiens
  misc_feature: GZ8MTXP02JBI6C.44.71.G05.1.454.CMB.2.raw
  modified_base (384)..(384): a, c, t, g, unknown or other
tcagacagtatatacacgaccggtgctcgatttagtgtcgtcgcaagagagaggagcccagccctggggactgaacagagagaactcaccatggagtttgggctgagctggcttttctgtggctgttttaaaaggtgtccagtgtgaagtgcagctgttggagtcgggggaggcttggtacagccgggggggtccctgacactctcctgtgcagcctctggattcgcctttaatacctatgccatgatctgggtcctcaggccccaggggaagggctggagtgggtctcatccattactggtggtagtgccacaaatgtcgcagactccgtgaacgggccgctcatccgtctccgagggacaattcccaagatacggtgtttcngcagatgaagagcctgcgagtggacgacacggtccctttataccgtgtacgccaggacgggtcgacagaacgttacaacaatacaaagtattaacactacagtcggacgtcgtaggggacaaacggggaccccgtcaacccggtctcctacgacgcctaccaccgacggtaccc

SEQ ID NO: 397446 - DNA, 600 bp, Homo sapiens
  misc_feature: GZ8MTXP02GCZVS.44.71.G05.1.454.CMB.2.raw
  modified_base (401)..(401): a, c, t, g, unknown or other
  modified_base (427)..(427): a, c, t, g, unknown or other
  modified_base (440)..(440): a, c, t, g, unknown or other
  modified_base (505)..(505): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcgggagggtcgggggggggggcttgggcacgagccgagggcggtctctgagactctcctgtgtagtctcaggattcagtcttagtgattatcacttggcctgggtcctcaggctccgaggggaggggcttggagtggatcactttcgcagaatgaaacgttagtggtaggaaagtaaagagtaccgccgacgtcgtggtaggaggggaanattccgaaccgtctacgaaaggggtntagacctccaaanagtgttaggaccatttaacaaatgaagcaaacctgagaccccgagacacgaggcctatattacgngccgaccgaggccacgtccgtagggggacctcgatcgacgttatttaggaagtttaggtttcgggggaccgaagggggacaaggttcgggtaccc

SEQ ID NO: 397447 - DNA, 790 bp, Homo sapiens
  misc_feature: GZ8MTXP02IUJQO.44.71.G05.1.454.CMB.2.raw
  modified_base (218)..(218): a, c, t, g, unknown or other
  modified_base (311)..(311): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctncactggaaccacagtgacgtcggtcgttttgaccgtgtctcctggtaccagcacgaccccaagaaaccacgacccccaaatcaatttatttangcggtacaatcgttccgccctttccggtcgtcccctgacgccgtcctttccgtcgtcggggtacccaaagttccgtacgggaccaccgaccgggtccccttacccccgtacgaacccctaacttccgttccgtcgggggtacccttccccggaagggtccgttacggggaacggggaacccggtaagggggtccttaaggttaaacttttaacgttaaccgttcgggacctaaacggtcctttaccaaagtttaacctaaaccggtaaaacgggttacggggtaaaacctttaacctttttaaacgttaacggtttccggggaccgaaccggtaaacgggggaaacccctaaagggtacccgttaacggtaaacccccggttaccgttaaaacggggtcccaaaaccggtaacccccgaaaaggggtccccttaccccgggtacccccccgtttcgggtacccttaacccgtttccccg

SEQ ID NO: 397448 - DNA, 607 bp, Homo sapiens
  misc_feature: GZ8MTXP02I6H3L.44.71.G05.1.454.CMB.2.raw
  modified_base (255)..(255): a, c, t, g, unknown or other
  modified_base (309)..(309): a, c, t, g, unknown or other
  modified_base (315)..(315): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatcctgggctcagtctgccctggctcacgcctccctccgtgtccgggtctccgtggacagtcagtcaccatctcctgcactggaaccaacagtgacgtcggttcgtttgaccgtntctctggtaccagcacgaccccaagaaaccacgacccccaaatcaattatttangcgtanaagtcgtcctccccgttcggtcgtcccctgacgccgtctttccctcgtcgggtacccaagtccgtacggaccaaccgccggtccccttcctcgaaccctatccttccgtcgggcctcccgagtcgtaggaacggacgacggctgtaattatactgacagcttacatataacaagtacggaaacttaacgtttaactacgttcggacgacgaacggggacaaacggctacgtaacccgtcgttaacggcaccgaacccgaaggtcctccggacccccttcggcctaccttccg

SEQ ID NO: 397449 - DNA, 548 bp, Homo sapiens
  misc_feature: GZ8MTXP02JVWO3.44.71.G05.1.454.CMB.2.raw
  modified_base (349)..(349): a, c, t, g, unknown or other
  modified_base (387)..(387): a, c, t, g, unknown or other
  modified_base (397)..(397): a, c, t, g, unknown or other
  modified_base (406)..(406): a, c, t, g, unknown or other
  modified_base (439)..(439): a, c, t, g, unknown or other
  modified_base (467)..(467): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcggaggtcgggggggggcttggcacagccgagggcggtctctgagactctcctgtgtagtctcaggattcagtcttagtgattatcacttggcctgggtccctcaggctccgaggggaggggcttggagtggatcactttcgcagaatgaaacgttntggtggaaagtaaagagtacgcgcgtctgtgagggganattcaccgtntcgaagggntgactcaacagtgtgctattacaatgagcaacngacgacccgagacacagcgtctattacncggcgccaggcgactccgtggggaccgtcgatcgctagtttgaagttagttcggggacctaggggactaaggtcggtaccg

SEQ ID NO: 397450 - DNA, 740 bp, Homo sapiens
  misc_feature: GZ8MTXP02JUTEO.44.71.G05.1.454.CMB.2.raw
  modified_base (309)..(309): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggctgttttaaaggtgtccagtgtgaagtgcagctgttggagtcgggggagcttggtacaggccggggggtccctgacactctcctgtgcagcctctggattcgcctttaatacctatgccatgatctggggtccgtcgacggccccgaggggaaggggctagggagtgggtctcatccatttacgnggtggtagtcgaccaacaaatgtcgcaacgaccttccggtaggaacgggccctattcatccccgtcctccgagggaactaacgttccaaagtacgttacggttgttttccagctaagataggaaacgcgtcccgtgggaccgaggtcgggaacgtaccgtaacgggttacccccttttaattacccgtggttaccgacccgaaggggtacggggtccacgtaaagggtaaaacgtttaaccaaaacgtaaaccgtaactaaaaggtttaactttaaaccgtaacctttaagaacgtttacgggacccgtttacgggtacgggggaaacccgaaaacccgggggtaacccccggttccaaacccggttcccttaaaccccggttcaaaaccggtcccccttacccgaaaaccccgggtaacgggtccccccg

SEQ ID NO: 397451 - DNA, 620 bp, Homo sapiens
  misc_feature: GZ8MTXP02IVHCY.44.71.G05.1.454.CMB.2.raw
  modified_base (230)..(230): a, c, t, g, unknown or other
  modified_base (288)..(288): a, c, t, g, unknown or other
  modified_base (309)..(309): a, c, t, g, unknown or other
  modified_base (331)..(331): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacngtgacgtcggttcgttttgaccgttgtctccgtggtaccagcacgaccccagaaaccncgacccccaaatcattattangcgtcatcgtcgcccttcggtntccctgacgcgtcttccgtcgtcggtcctaagtctggacacgccggcctcccgtgacccgttctcgtcgggcctccgacggtctaggacgtagtcggacggtcgttagtattacttacgtcgcgtacgtccgtaccgaggtcgggaacggcctaaccgttagttacgttacgtttcggttccggttttcggggaccgggtaacggtaccgaggtaccgtcggtacccgtcgtacggtaccgaccgcccgaacggtccgtcccgtcccccgtcgtacctaccgtttcccg

SEQ ID NO: 397452 - DNA, 597 bp, Homo sapiens
  misc_feature: GZ8MTXP02HIRIJ.44.71.G05.1.454.CMB.2.raw
  modified_base (269)..(269): a, c, t, g, unknown or other
  modified_base (275)..(275): a, c, t, g, unknown or other
  modified_base (293)..(293): a, c, t, g, unknown or other
  modified_base (331)..(331): a, c, t, g, unknown or other
  modified_base (410)..(410): a, c, t, g, unknown or other
  modified_base (422)..(422): a, c, t, g, unknown or other
  modified_base (439)..(439): a, c, t, g, unknown or other
  modified_base (466)..(466): a, c, t, g, unknown or other
  modified_base (475)..(475): a, c, t, g, unknown or other
  modified_base (507)..(507): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggcttgggcacagccaggggcggtctctgagactctcctgtgtagtctcaggattcagtcttagngattancacttggcctgggtcctnaggctccaggggaagggcttggagtggatcactttcgnaagaaatgaaaacgttatggaggaaaagtaaaacgagtaaccgccgagtctggagaaggggaactattccgaaccgttnacgaaaaggggntagaacttacccaaagngtgttgacctaatttaacaaaatgaancaaaaccgngaacgaccgagacacgtaggctactaatacgngaccacgaaggtcgacgtccggagggaccgtgacgtacgtacgtagttagtaagttagttacgggtacggacgggaacgaacgtacgtcg

SEQ ID NO: 397453 - DNA, 690 bp, Homo sapiens
  misc_feature: GZ8MTXP02G3UYX.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtggcgggaggtcgggggggggcttgggcacgaggccgagggcggtctctgagactctcctgtgtagtctcaggattcaggttcttagtgtatttatctacgttggccgtggggtcccgtcgaggcctaccggaggggaaggggtcttagggagtggatctacgttttcgcagaatagtaaacgttagtaggtaggtaaagtaaacgacgtacgccgtgtacgtggtaggaagggggtaactagttaccgaaccgttcgtaacgaaaggggtactagaaccttacccgaaaagtggttaggttacggaccttaatttaaacgtaaaagtagaaacgacctaaaccgtgaaaccggaaccccggaacgaactaaccgaagggtaccttactaacgtttacgcggccgacccgaagggcgtaacgtcccggtaggggaccttggaaattcgacttagtttagaagttaggttcggggaccgaaggggacctaggtcggtaccg

SEQ ID NO: 397454 - DNA, 523 bp, Homo sapiens
  misc_feature: GZ8MTXP02HZX3L.44.71.G05.1.454.CMB.2.raw
  modified_base (257)..(257): a, c, t, g, unknown or other
  modified_base (294)..(294): a, c, t, g, unknown or other
  modified_base (367)..(367): a, c, t, g, unknown or other
  modified_base (372)..(372): a, c, t, g, unknown or other
  modified_base (411)..(411): a, c, t, g, unknown or other
  modified_base (422)..(422): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccgggtctcctggacagtcagtcaccatctctgcactgaaccacagtgacgtcggtcgtttgcgtgtctctgtacngcacgacccagaacacgaccccaaactcatttattancgcgtcaattcgttccgcccttcggtcgtccctgacgcgtcttcctcgtcggtcagtctcgcacgcgcctccngaccntctctcggctccgagctgaggacgaggctagattatacngcagctcatanacgtaagtggaaactatttactagttcgacgacgtaacgggacctagctacgaccgtcgtacgcacgcccgacgcctccgcccctacggtcctacgtcccg

SEQ ID NO: 397455 - DNA, 574 bp, Homo sapiens
  misc_feature: GZ8MTXP02GRW7G.44.71.G05.1.454.CMB.2.raw
  modified_base (392)..(392): a, c, t, g, unknown or other
  modified_base (397)..(397): a, c, t, g, unknown or other
  modified_base (408)..(408): a, c, t, g, unknown or other
  modified_base (482)..(482): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggctgttttaaaaggtgtccagtgtgaagtgcagctgttggagtcgggggaggcttgatacgagccgggggggtccctgacactctcctgtgcagcctctggattcgcctttaatacctatgccatgatcgtggggtcccgtcacggccccgaggggaaggggctggagtggggtctcgatccattacgtggtgtagtgaccaacaaatgtcgcagacctcggtgaacgggccgcttcactcgtctcgaggacaattccagaatacggtntttcngcagatagaanagcctgcgagtggaccgacgtacggtccctttagtacctgtcgccaggaggggtccagaagaaagttaccaaanaataacaaagttataactactacagtggacgtgtacgggacgaaaaccgggcccgtcaaccgtctcctacacgtcccaccgaaccgaaccgg

SEQ ID NO: 397456 - DNA, 657 bp, Homo sapiens
  misc_feature: GZ8MTXP02JDI4D.44.71.G05.1.454.CMB.2.raw
  modified_base (278)..(278): a, c, t, g, unknown or other
tcagacagtatatacacgaccggtgctcgatttagtgtcgtcgcaagagagagggcccagccctgggactgaacagagagaactcaccatggagtttgggctgagcgtgcgtttctagtggctagtttaaaggtgtcagtgtgaagtgcagctgttggagtcgggggaggcttggtacaggccggggggtccctgacactctcctgtgcagcctctggattcgcctttaatacctatgccatgatctgggtcctcaggccccagggaaggggctgggngtggtctctatctatacgtggtggtagtcgacactaagtacgtcgacgacgtacgtccgtacggacggccgtctctacgtcgtcccgtaccgacgtactaactacgtaacgtaacgtacgttcgttcgtcgtacgtagtagtagagacgcgtgacgtaggtacggacgacgtaccgtaccgttacgttacgtcgtcgacgacggtacgggtacggtacgtaacgtaacgtaaactaaacgtaaactaacgtaagtaacttaactaactaacgtacgtacggtacgtacggtacgggtaacggtaaaccgggtacccggtaccgtaccgtaccgtaaccgtaccgtaccgtaccgtacccgaccgaccggtaccgtaccg

SEQ ID NO: 397457 - DNA, 557 bp, Homo sapiens
  misc_feature: GZ8MTXP02FWIOS.44.71.G05.1.454.CMB.2.raw
tcagacagtatatacacgaccggtgctcgatttagtgtcgtcgcaagagagaggagcccagccctggggactgaacagagagaactcaccatggagtttgggctgagctggcttttcttgtggctgttttaaaggtgtccagtgtgaagtgcagctgttggagtcgggggaggcttggtacaggccggggggtccctgacactctcctgtgcagcctctggattcgcctttaatacctatgccatgatctgggtcctcacggccccaggggaaggggctggagtgggtctcatccattactggtgtagtgccacaaatgtcgcagactccgtgaacgggccgctcatccgtctccagggacaattccaagtatacggtgtttctgcagatgaagagcctgcgagtggacgacacggtccctttatacctgtcgccgaggcgggtcgcgaagaaacgttacaaactaaatacaaagttattaactactactagtggacgtcgtaggggacaaacggggaccccgtcaccgtcctcctcacgcctaccacgacggaccc

SEQ ID NO: 397458 - DNA, 652 bp, Homo sapiens
  misc_feature: GZ8MTXP02IW9KW.44.71.G05.1.454.CMB.2.raw
  modified_base (394)..(394): a, c, t, g, unknown or other
  modified_base (419)..(419): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgagggcgactggcgggaggtcgggggggggcttgggcacgaggccgagggcggtctcgtgagactctcctgtgtagtctcaggattcagtcttagtgtattatcacgttggcctgggtcccgtcgaggcctccgaggggaggggtcttggagtggatctacgtttcgacagtaatagtaaacgttagtaggtaggaaagtaaagagtacgccgcgtntggtagaggggatattccgaccgtntacgaagggatacgacctaccaacgtagttcgttaggacctaagtttaacaaagttgaacgcctaaaaccgtggaaaccgaccccggaacgaccaacgacgggtcctacttaattaccgcgaccgacccgagggccgtaacgtccggtacggggacccgtacgaagtcgacttaagtttaggaagtttaacgggttcggggacccgtaagggggactaacggttcgggtaccc

SEQ ID NO: 397459 - DNA, 544 bp, Homo sapiens
  misc_feature: GZ8MTXP02F0A8G.44.71.G05.1.454.CMB.2.raw
  modified_base (343)..(343): a, c, t, g, unknown or other
  modified_base (358)..(358): a, c, t, g, unknown or other
  modified_base (381)..(381): a, c, t, g, unknown or other
  modified_base (391)..(391): a, c, t, g, unknown or other
  modified_base (402)..(402): a, c, t, g, unknown or other
  modified_base (472)..(472): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggcttgggcacagccagggcggtctctgagactctcctgtgtagtctcaggattcagtcttagtgattatcacttggcctgggtcctcaggctccgaggggagggcttggagtggatcatttcgcagaatgaaacgttnggtaggaagtaaagngtacgcgcgtctggtgagggganattcaccgtntcgaaaggggntgactccaacagtgttggcctatttaacaaatgagcaaactgacgacccgagaccacgagcgtactatcngcgaccaggcactccgtgggacgtcgagtcgctatttgaagttagtttcggggaccaggggacaagtcggtc

SEQ ID NO: 397460 - DNA, 566 bp, Homo sapiens
  misc_feature: GZ8MTXP02G8FU0.44.71.G05.1.454.CMB.2.raw
  modified_base (451)..(451): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcatggaaccacagtgacgtcggtcgtttgaccgtgtctcctggtaccagcacgaccccagaaacacgcccccaaactcattatttatgcggtacaattcgttaccgtccccgttccggtcgtcccctggacgcgtctttccctcgtcgggtccaagttctggacacgacggcctccctgaccatctcgtcgggctcccgagctggagacgagctagatttatactgcagctcatanacgaagtaggaactactttacagttcggcgcgaacggggacctaaaggccttaggaacccgttcgtacggtccacgaaccccgaaggcctccgccccctcggtaccactttcccg

SEQ ID NO: 397461 - DNA, 610 bp, Homo sapiens
  misc_feature: GZ8MTXP02JHQJZ.44.71.G05.1.454.CMB.2.raw
  modified_base (533)..(533): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgacgtggcggaggtcggggggggcttggcacgagccgagggcggtctctgagactctcctgtgtagtctcaggattcagttcttagtgattatcacttggcctggggtcccgtcgaggcctccgaggggaaggggtcttggagtggatcgacttttcgacagtaatgtaaacgttgtgggtaggtaaaagtaaagagtaccgcccgacgttcgtaggttagaagggggaatagttccgaaccgtctacgaaaggggatacgacctacgaactaggtgttcggacctatttaacaaattgaacgcaaaccgtgacgaccccgacgacacgacgcgtactataccgtgccncgagcgacgtccgtgggaacctgatcgacttagtttagaagttggttacggggcctaaggggacctaagtcggtacc

SEQ ID NO: 397462 - DNA, 616 bp, Homo sapiens
  misc_feature: GZ8MTXP02IO0H8.44.71.G05.1.454.CMB.2.raw
  modified_base (209)..(209): a, c, t, g, unknown or other
  modified_base (281)..(281): a, c, t, g, unknown or other
  modified_base (298)..(298): a, c, t, g, unknown or other
  modified_base (340)..(340): a, c, t, g, unknown or other
  modified_base (391)..(391): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactgggcgggaggtcgggggggggnttgggcacgaggccaggggcggtctctgagactctcctgtgtagtctcaggtattcagtcttagtgatttancacttggcctgggcctnaggctcgaggggaagggcttgagtggatcatttcgcagaatnaaacgttatggtaggaaataaagagtacgcgtcgtctaggtgagggggaanagttcacccgtctacgaaaggggactgtaactacctaaacagtacggttaggacctaatttaacaaaattagagacaaacctagacgaacccgacgaacacgaaggctacggggtaattacgcgccgacgaacggcgaactccggtcggggaaccgtacgtaacgtagcctaagtttggaacttagtttacgggggcccgaagggggacctaaaggtcggtaccg

SEQ ID NO: 397463 - DNA, 614 bp, Homo sapiens
  misc_feature: GZ8MTXP02GBKQC.44.71.G05.1.454.CMB.2.raw
  modified_base (285)..(285): a, c, t, g, unknown or other
  modified_base (379)..(379): a, c, t, g, unknown or other
  modified_base (424)..(424): a, c, t, g, unknown or other
  modified_base (446)..(446): a, c, t, g, unknown or other
  modified_base (516)..(516): a, c, t, g, unknown or other
  modified_base (524)..(524): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgactgggcgggaggtcgggggggggcttgggcacgaggccgaggggcggtctcgtgagactctcctgtgtagtctcaggattcagttcttagtgtattanctacgttggcctggggtcccgtcgaggcctccggaggggaaggggtcttggaggtggatcgacgttttcgacaagaaataggtaaaacgttagnggtaggaaagtaaagagtaccgcgtcgtctaggtaggaagggganattcgaccgtctacgaaagggntagacctccaaagtgtgttcgacctatttaacaaatgaagcaaacctgaacgacccgagacagaggcctntattacgngccgacgaggcacgtccgtggggactcgattcgactagtttgaagtttacggttcgggggacccaaggggtaaccaaggttcggtacccg

SEQ ID NO: 397464 - DNA, 653 bp, Homo sapiens
  misc_feature: GZ8MTXP02F1FP6.44.71.G05.1.454.CMB.2.raw
  modified_base (401)..(401): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtccagtgtgaagtgcagctgttggagtcgggggagcttggtacaggccggggggtccctgacactctcctgtgcagcctctggattcgcctttaatacctatgccatgatcgtgggtcctcaggccccaggggaaggggctggagtgggtctcagtcccattacgtggtggtagtgccacaaatgtcgcagactcccgtgaacgggccgacttcactcgtccctacccgagggacctaattcccaaagtactaccggggtttnttacgtgactagagtagaacgacgcgtaggcgtaggtacggaccgaccgtaccgttacctttaagtcgtgtcgtaccgaggtacgggtacgacgtaagtaaacgtaacaaacgtaataaacgtaagttaacttaacctaactacgtagtacggtacgtacggtacggggaaaccgtaaacccggggtaccccgtaccgtacccgtcctaacccgtcgaccgtacccgacccgaaccggaccggtaccctacg

SEQ ID NO: 397465 - DNA, 560 bp, Homo sapiens
  misc_feature: GZ8MTXP02H6JOS.44.71.G05.1.454.CMB.2.raw
  modified_base (228)..(228): a, c, t, g, unknown or other
  modified_base (306)..(306): a, c, t, g, unknown or other
  modified_base (433)..(433): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtcccgggtctcctggacagtcagtcaccatctcctgcactggaaccanagtgacgtcggtcgttttgaccgtgtctcctggtaccagcacgaccccagaaacacgacccccaaactcattatttangcgtcaatgttcgcccttcggtgtcccctgagcgtcttcctcgtggtccagtctggcacgcgcctccctgacccatcctcgtggctccgagctaggagacgaggtctagtattagtactgctagctnatatacaaggtaggaaactacgtttaactagttcggtacgcgtaacgggaaccaagtcctacgaacccgttccgtaacgggtcacgcccgaacggcccttcggcccccgtcggtcctaaccttcccg

SEQ ID NO: 397466 - DNA, 590 bp, Homo sapiens
  misc_feature: GZ8MTXP02JP0FX.44.71.G05.1.454.CMB.2.raw
  modified_base (348)..(348): a, c, t, g, unknown or other
  modified_base (382)..(382): a, c, t, g, unknown or other
  modified_base (404)..(404): a, c, t, g, unknown or other
  modified_base (414)..(414): a, c, t, g, unknown or other
  modified_base (428)..(428): a, c, t, g, unknown or other
  modified_base (489)..(489): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggcttggcacagccagggcggtctctgagactctcctgtgtagtctcaggattcagtcttagtgattatcacttggcctgggtccgtcaggctccgaggggaggggcttggagtggatcactttcgcagaatggaaacgtttanggtaggaaagtaaacgagtacgccgcgttctggngaaggggatattccgaccgtcncgaaaggggntacgactccaacgngtgtgcctattaacaaatgagacaaacctgacgacccgagaccacgaggctactacttacncgacggccaaggccgtaactcccgtggggtaaccgtcgaagttcggcctagtttgaatttaggtttacgggggcctaagggggacctaagtcgggttaccc

SEQ ID NO: 397467 - DNA, 580 bp, Homo sapiens
  misc_feature: GZ8MTXP02F4K07.44.71.G05.1.454.CMB.2.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctcctggtaccagcacgaccccagaaaccacgacccccaaactcattattatgcgtcaatcgttccgccccttcggtcgtcccctgacgcgtcttcctcgtcgggtcaagtctggcacgaccggccctccctcgaccatcctcgtcgggcctccgaggctggaggacgaggtctagtattatacgtgcagctacatacacaaggtaggaaacttactttactagttcggacgtacgaacgggaccaagcgtacgacccgttcgtacggtccaacgaaccccgaaaggtcccgtaccggtccccccgtggtaccctacgtttcccg

SEQ ID NO: 397468 - DNA, 570 bp, Homo sapiens
  misc_feature: GZ8MTXP02H9TNF.44.71.G05.1.454.CMB.2.raw
  modified_base (243)..(243): a, c, t, g, unknown or other
  modified_base (251)..(251): a, c, t, g, unknown or other
  modified_base (398)..(398): a, c, t, g, unknown or other
  modified_base (429)..(429): a, c, t, g, unknown or other
  modified_base (455)..(455): a, c, t, g, unknown or other
tcagacagtatatacacgaccggtgctcgatttagtgtcgtcgcaagagagagggggggatctcaggaggcagctctctcggaatatctccaccatggcctgggctctgctgctcctcactctcctcactcaggacacagggtcctgggcccagtctgccctgactcagcctgcctccgtgtctgggtatcctggacagtcgatccaccttctctgcactggactcagcagtgagctcacttntaatgtcncctcctgtactcaactacactcccgaccaaacccccaaactctgactcatagaaatctactaagccgtaccctcgtgggtactttcgtagtctcgtctttctcgtcgtcctccgacggtcccggacaaccgaccgtccctcccgtanactactctcgtccggtctaccgacgtcccgnggacgacgaggctaggacttattacngcgtctactacttacacttctagacgtcgttgggcgtttcggcgttacgggactaccgtaccgtacgtacccgtaacgtacgtccgacgaccccgaggtcccttccgtcccccgg

SEQ ID NO: 397469 - DNA, 590 bp, Homo sapiens
  misc_feature: GZ8MTXP02F6IV9.44.71.G05.1.454.CMB.2.raw
  modified_base (191)..(191): a, c, t, g, unknown or other
  modified_base (225)..(225): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcacccaggacacagggtcctgggcccagtctgccctgactcagcctgcctccgtgtctgggtcncctggacagtcggtcaccatctcctgcactgganccagcgtaatattcttagtcttaattgtctctgtatcaacatcatccaagtaaacgacccccaaatcatcatctatgagcctataagcgccctgtagggttctaatcgccttcactgcctcaacgtccgcaacacggcctccctgactaactctcgtggcctccgaggctagacgacgagctagtatttattagtttgtgtctacgagtacgttgttccgtcgactacttactatttagttcgttacgttacgggtaaaggttcgggtaacccgtaaaggttaccctaacccggttaccgtacggtaccaaccggtacccccgaaacgggacccccaaaccccgtacttcggtaacctttacccg

SEQ ID NO: 397470 - DNA, 710 bp, Homo sapiens
  misc_feature: GZ8MTXP02G7OOS.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgactgggcggaggtcgggggggggcttggcacgaggccgagggcggtctcgtgagactctcctgtgtagtctcgaggtattcagtcttagtgtattatcacttggcctggggtcccgtcgaggcctccgaggggaagggtcttggagtggatctactttcgcaagtaatagtaaacgtttatgggtaggtaaagtaaagagtaccgccgcgtcgtaggtaggaggggaagtacttccgaccgttcgtacgaaaggggactacggacctacccgaaagtaggttcggttacgggacccttaaattttaaaccgaaaagttggaaacgtaccgaaaaccgttggaaaccgaacccccggaacggaaaccaccggtacgggtaccgttaccgttaaagtttaccgcggcccggaccgacgggaccgtacgtcccggtagggggaaccgttcggaagttcggacttaggttttacgaagtttaggtttacgggggacccgtaagggggtaacctaaggttcggtacccg

SEQ ID NO: 397471 - DNA, 610 bp, Homo sapiens
  misc_feature: GZ8MTXP02GNBLG.44.71.G05.1.454.CMB.2.raw
  modified_base (584)..(584): a, c, t, g, unknown or other
tcagacagtatatacacgaccggtgctcgatttagtgtcgtcgcaagagagaggagcccagccctggggactgaacagagagaactcaccatggagtttgggctgagctggcttttctgtggctgttttaaaaggtgtccagtgtgaagtgcagctgttggagtcggggggaggcttggtacaggccgggggggtccctgacactctcctgtgcagcctctggattcgcctttaatacctatgccatgatctgggtccgtcaggccccaggggaagggctggagtgggtctcatccattactggtgtagtgccacaaatgtcgcagactccgtgaacgggccgcttcgatcccgtctccgaggaactacttaccgaaagtacgtacggttgtttcgcgacgaagataggaagacgtacccgtgacggtaggtacgggaacgtaccgtaccggttaccctttaagtaccgtgtacgaccgagggtacgggtcacgaagtaaagtaaccaaataactaaactaagttataactactacagtacgacgtcgtacgggacgaaaccgggcccgtacgaccgtcctacncgaccgtccaccgaacgacggtcccg

SEQ ID NO: 397472 - DNA, 671 bp, Homo sapiens
  misc_feature: GZ8MTXP02J0OZK.44.71.G05.1.454.CMB.2.raw
  modified_base (306)..(306): a, c, t, g, unknown or other
  modified_base (377)..(377): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcaggacacagggtcctgggcccagtctgccctgactcagccctccctccgcgtccgggtctgtcggcagtcagtcaccatctcctgcactggcaccagcagtgactagttggtagttattaactttgtctctggtaccaacaccaccagacaaacgccccaaattcatcatttangatgtcagtaacgcggccctcgacgggtcctgactccgcttctcgtcgctaccaagtcgtcggactaaccnccgggtccctcccgtacgtacccgttccgtccgtcgggcctacccggaacgggtcgtagggacggtacgttacgggaacgggtccttacggtactttacgttttcctcggtccctttccgtacctattacgtcggacgaacgggtcgtaacgtttaggttttacgtacggttcgttaacgggtaacgtacgggtaaacccgtaacgggttacccgacccggttcccgtaaccggttccgaaccggtaccccgaaccgggttacccccaacccccgttacgtacggttaaccccg

SEQ ID NO: 397473 - DNA, 657 bp, Homo sapiens
  misc_feature: GZ8MTXP02JB5G8.44.71.G05.1.454.CMB.2.raw
  modified_base (428)..(428): a, c, t, g, unknown or other
  modified_base (448)..(448): a, c, t, g, unknown or other
  modified_base (452)..(452): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctcctgtaccagcacgaccccagaaaccacgacccccaaactcattatttatgcgtacaagtcgttccgtccccttccggtcgtcccctgacgcgtccttcctcgtcggtcaagtctgcacgaccggccctcctcgacctatcctcgtcggcctcccgaggtctggaggacgnggctgtattatacgtgcgancctnaattataaaccgtaaagggttacgggtaaaccttaacgtttttaaacgtgtttaccgggaccgaaccggtaacggggaaaccccgtaaaggtccgttaacggtaacccccggttcccgttaaacgggggtccccaacgggtaacccccgaaacgggtaccccgtcccggtacccccccgttcggtaccccgtacctttcccccgg

SEQ ID NO: 397474 - DNA, 531 bp, Homo sapiens
  misc_feature: GZ8MTXP02H2N3A.44.71.G05.1.454.CMB.2.raw
  modified_base (277)..(277): a, c, t, g, unknown or other
  modified_base (348)..(348): a, c, t, g, unknown or other
  modified_base (370)..(370): a, c, t, g, unknown or other
  modified_base (384)..(384): a, c, t, g, unknown or other
  modified_base (394)..(394): a, c, t, g, unknown or other
  modified_base (403)..(403): a, c, t, g, unknown or other
  modified_base (413)..(413): a, c, t, g, unknown or other
  modified_base (454)..(454): a, c, t, g, unknown or other
  modified_base (467)..(467): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacagccaggggcggtctctgagactctcctgtgtagtctcaggattcagtcttagtgattancacttggcctgggtccgtcaggctccgaggggagggcttggagtggatcactttcgcagaatgaaacgttnggtaggaagtaagagtacgcgngtctgtagaggganattcaccgtntcgaagggntgactcaacngtgttgactattacaaatgagcaactgacacccgagaccancgcgtctattacngccgcaggcactccgtgggacctgatcgctattgaattgttggggccaggggacagtacggtcc

SEQ ID NO: 397475 - DNA, 625 bp, Homo sapiens
  misc_feature: GZ8MTXP02FJX5C.44.71.G05.1.454.CMB.2.raw
  modified_base (282)..(282): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaccaacagtgacgtcggtcgtttgaccgtgtctcgtgtaccagcacgaccccagaaacncgaccccaaatcattattatgcgtacaatcgttccgcccttccggtcgtccctgacgccgtcttccctcgtcggtacagtcgtggacaccgccggtccctcccgtgaccctatcctcgtcgggcctcccgaggcctaggaacggaccgaggctagtattacttactgacagtctataattaatacgtaaaggtacggaaacttaacgtttacgtagttccgggacgaccggaacgggacccaaaggtccgttacggtaaccccggttccgttaaacgggtccgaaacggaaccccgaaacggtcccgtcccggtccccccgttcggtacctacccgtttcccg

SEQ ID NO: 397476 - DNA, 687 bp, Homo sapiens
  misc_feature: GZ8MTXP02FNSZD.44.71.G05.1.454.CMB.2.raw
  modified_base (357)..(357): a, c, t, g, unknown or other
tcagacagtatatacacgaccggtgctcgatttagtgtcgtcgcaagagagaggagcccagccctggggactgaacagagagaactcaccatggagtttgggctgagctggcttttcttgtggctgttttaaaaggtgtccagtgtgaagtgcagctgttggagtcgggggaggcttggtacaggccgggggggtccctgacactctcctgtgcagcctctggattcgcctttaatacctatgccatgatcgtggggtccgtcacggccccgaggggaaggggctgggagtgggtctcgatccattacgtggtggtagtgaccacaaatgtcgcagacctccggtaggaacgggccnttcatcccgtctccgagggactaattcccaaagtacgtacgggtgtttctagacaagtataggaaagacgtcccgtaggccgaaggtcgggaacgaccgtaacgggtctttacgttttattacgtggtcgacccgtaagggtacggggttccgacgtaaaggtaaaaccgtttaacaaaacctaaagttaaacctaaagttaatttaacctaaacttaactaaggttcgggaacgttcggtacgggggaaccgtaaaaccgggggacccccgttacgaacccgttccgtaccctacgacccgtcccctacccgaaccgtaaaccccgggg

SEQ ID NO: 397477 - DNA, 521 bp, Homo sapiens
  misc_feature: GZ8MTXP02FPFTL.44.71.G05.1.454.CMB.2.raw
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaccaacagtgacgttcggtcgttttgaccgtgtctcctggtaccagcacgaccccagaaaccacgcccccaaactcattattatgcgtcaatgttcgcccttccggtgtccctgagcgtcttcctctgggtccagtctggcacacggccctccctgaccatctctgggctccgaggctgaggacgaggctgattatactgcagctcatatacaagtggaactactttactattcggcgacgacgggaccaagctgaccgtctaggtcacgcccgaagctcgccccctcggtcactccg

SEQ ID NO: 397478 - DNA, 737 bp, Homo sapiens
  misc_feature: GZ8MTXP02IDULR.44.71.G05.1.454.CMB.2.raw
  modified_base (262)..(262): a, c, t, g, unknown or other
  modified_base (280)..(280): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgagccgagggcggtctcgtgagactctcctgtgtagtctnaggtattcagttcttagngtaattatcacgttcggccgttcggggtcccgtacgaggtcctacggaagggggtaacggggtcttggtaggtggtatccgtaacgttttcggacaaagtaaattacggaaaacgtttagtagggtaaggaaagtaaaacggagtaccggccgtgttacgtggtaggagggaagtacttaccgaaccgtcttacggaaagggtatacgaacctacctaaacgtggttagttacggtaccttaaaagtttaaacgaaaagttcggacgaaacctaaaaccgttggaaaccgacccggaacgaacacccggaaggtccgttaacttaaagtaccgtgggacccacggtaggaccgtacgttacccggtagggggaaccttcggaagttcggactttagtttaggaacgtttggggtttaccgggggaccgtaagggggtacctaaaggttcgggtaccc

SEQ ID NO: 397479 - DNA, 635 bp, Homo sapiens
  misc_feature: GZ8MTXP02IKQ8I.44.71.G05.1.454.CMB.2.raw
  modified_base (280)..(280): a, c, t, g, unknown or other
  modified_base (298)..(298): a, c, t, g, unknown or other
  modified_base (352)..(352): a, c, t, g, unknown or other
  modified_base (376)..(376): a, c, t, g, unknown or other
  modified_base (392)..(392): a, c, t, g, unknown or other
  modified_base (477)..(477): a, c, t, g, unknown or other
  modified_base (524)..(524): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcggaggtcgggggggggcttgggcacgagccgagggcggtctctgagactctcctgtgtagtctcaggtattcagtcttagtgattancacttggcctgggtcctnaggctccgagggagggtctgagtggatctactttcgcaagaatgaaacgtttanggtaggaagtaagacgtacgccgngtcgtgtagagggganatttaccgacccgttctacgaaaggggtatacgacctacccgtaaaagaggttgttcggaccctaattttaaacaaaatggaaanacccaaacttagaaaccgacccgagaccacgaacggctactattacnggccgacgagggaccacttcccggagggacccgttaggacttcggactttagtttagaagtttacggtttacgggggacccgtaagggggaccctaaaggtcgggtaaccc

SEQ ID NO: 397480 - DNA, 591 bp, Homo sapiens
  misc_feature: GZ8MTXP02H9OQQ.44.71.G05.1.454.CMB.2.raw
  modified_base (228)..(228): a, c, t, g, unknown or other
  modified_base (263)..(263): a, c, t, g, unknown or other
  modified_base (307)..(307): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatcctgggctcagtctgccctggctcacgcctccctccgtgtccggtctccgtggacagtcagtcaccatctcctgcactggaaccangtgacgtcggtcgtttgaccgtgtctctggtaccngcacgaccccaagaaaccacgaccccaaactctaatttatttangcggtacaattcgttccgtcccctttccggtcgtcccctgacgtcgtcttcccgtcgtcgggtccaagtctggacctaccgaccggtccctcccgtacgaacctacgtccttcgtcgggtcctccgaggctaggaggacgaggtctagtaactttactactgcagtcttacatactaagaggtacggaacttacttactagtcggactacgacggtaccagtcctacggaccgtcgtacgtcacgcccgacggcctccgcccccgtcggtacctaccgttcccg

SEQ ID NO: 397481 - DNA, 559 bp, Homo sapiens
  misc_feature: GZ8MTXP02HDP7P.44.71.G05.1.454.CMB.2.raw
  modified_base (300)..(300): a, c, t, g, unknown or other
  modified_base (439)..(439): a, c, t, g, unknown or other
  modified_base (457)..(457): a, c, t, g, unknown or other
  modified_base (471)..(471): a, c, t, g, unknown or other
  modified_base (499)..(499): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacaggccgagggcggtctctgagactctcctgtgtagtctcgaggattcagttcttagtgattatcacttggcctgggtcccgtnaggctccgagggagggcttgagtggatcactttcgcagaatgaaacgttatggtaggaagtaaagagtacgcgcgtctggtagaggggagattcaccgtctcgaaagggatgactccaacagtgtgctattacaatgancaaactgaacgacccganacacgaggtccgtntatactgccgaccagggcccgatcccgngggaccgtcgatcgactatttgaattaggttcggggccgtaaggggacaacgtggtaccg

SEQ ID NO: 397482 - DNA, 503 bp, Homo sapiens
  misc_feature: GZ8MTXP02GBXQ3.44.71.G05.1.454.CMB.2.raw
  modified_base (286)..(286): a, c, t, g, unknown or other
  modified_base (322)..(322): a, c, t, g, unknown or other
  modified_base (388)..(388): a, c, t, g, unknown or other
  modified_base (400)..(401): a, c, t, g, unknown or other
  modified_base (409)..(410): a, c, t, g, unknown or other
  modified_base (417)..(419): a, c, t, g, unknown or other
  modified_base (422)..(422): a, c, t, g, unknown or other
  modified_base (428)..(428): a, c, t, g, unknown or other
  modified_base (459)..(459): a, c, t, g, unknown or other
  modified_base (462)..(462): a, c, t, g, unknown or other
  modified_base (489)..(489): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaaccaacagtgacgtcggtcgtttttgaccgtgtctcctggtaccagcagaccccagaaaacngcccccaaaatcattatttatgcggtcaaatgttcncccttccgtgtccctgagcgcttcctctgggtccaaagtctggcacacggcctccctgacccatcnctggctccagcnngacgaggnnatatatnnnctnatatanaagtagatacttactatcgcgcgacgacaanacncgacgtctacgcacaaccgacgacgcncccgtccgtcactc

SEQ ID NO: 397483 - DNA, 657 bp, Homo sapiens
  misc_feature: GZ8MTXP02FX78T.44.71.G05.1.454.CMB.2.raw
  modified_base (354)..(354): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggcttgttttaaaaggtgtccagtgtgaagtgcagctgttggaggtcggggggaggcttggtacaggccggggggtccctgacactctcctgtgcagcctctggattcgcctttaatacctatgccatgatctgggtcctcacggccccgaggggaacgggctggagtgggtctcatccattacgtggtggtagtgaccaacaaatgtcgcagacctccgtggaacgggccncttcattccgtcctcccgaaggggaacctaaattacccaaaagtacgtacgggttgtttcgtgcaagataggaaagtacgccctgacggaggtcgggaaccgaccgaacggtaccccttttaagtaccgtggtacgcccgaagggacggggtccgacgaaggtaaaacgttaaccaaacaaattaaaccgaaagttacttaaactactaactagtaggacgtcggtacgggggaaccaaaaccgggggtacccccgtcaacccgtctacccgtacgacgccctaacccgaccgaacgggcccc

SEQ ID NO: 397484 - DNA, 560 bp, Homo sapiens
  misc_feature: GZ8MTXP02HL4UD.44.71.G05.1.454.CMB.2.raw
  modified_base (358)..(358): a, c, t, g, unknown or other
  modified_base (385)..(385): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcatccaccaggcacacgcccccagactcgtgattttgaggtcaagtacgcgccctgacggggtcccgagtcggtcctctgctaccagtcngcaacacggcctccctgaccgtctcgnggcctcgagctgacgatggagctgattatactgtacagtctccgagtgacggctactagtgtagtttgcgttttcgggacggtacgggtaccaggtacgtacgacccggttaccgtaggtcgaaaccgtcccgaaacggggtcctcccgtccccccggttacggtacccgtcccg

SEQ ID NO: 397485 - DNA, 642 bp, Homo sapiens
  misc_feature: GZ8MTXP02JKSH4.44.71.G05.1.454.CMB.2.raw
  modified_base (501)..(501): a, c, t, g, unknown or other
  modified_base (508)..(508): a, c, t, g, unknown or other
  modified_base (547)..(547): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtcgtccgggtctcctggacagtcagtcaccatctcctgcactcggaaaccaacagtgacggttcggttcgtttggaccgttgtctccgtggtaccagcacgaaccccaagaaaccaccgacccccaaatctaatttatttagcgtacggtacaattcgttccgtcccgttcggtctccctgacgtcgtcttccgtacgtcgggtacctaagtctacggacaccgcccgccttcccgtacgaccctatccgtcgtcggggtcctacggacggtcgtacggaagggacgacggtcttaagtacttatacgtgactagtactanaacttanaacgtaagtacggtaaacttactttacgtagtaccgganaccgtaacgggaaccagtcgtaacgacccgttaccgacggtaccaccggaacctaacggggccctaccggtccccgtacgtacctccgtttcccg

SEQ ID NO: 397486 - DNA, 633 bp, Homo sapiens
  misc_feature: GZ8MTXP02GERRA.44.71.G05.1.454.CMB.2.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcacgcctccctcgtcgtccgggtctcctggacagtcagtcaccatctcctgcactcggaaaccaacagtgacgtcggttcgtttgaccgtgtctctggtaccagcacgaccccaagaaaccacgaccccaaactctaatttatttagtcgtacggtacaagttcgttccgtcccgttcggtcgtccctgacgtccgtcttcctcgtcggtacagtcgtcgacacgccgtcctcgctcgactatccgtcgtcgggacctcgaggtcgtaggacggaccgaggtctagtaactttatacgtggactagtctactaagtaacgtaacgaaggttacggaaactttaaccgtttagttacgtcggaccgtacggaacggaactaaacgtccgtacggtacccgtacgtacggtaccgaacggtaccccgaaacggtcccgtccccggtaccccgttcggtacccttcccg

SEQ ID NO: 397487 - DNA, 760 bp, Homo sapiens
  misc_feature: GZ8MTXP02IM7DP.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggcttgggcacgagccagggcggtctctgagactctcctgtgtagtctcaggattcagttcttagtgattatctacgttggcctgggtcccgtcaggctccgaggggagggcttggagtggatctacgtttcgacagtaatgaaacgttgtggtaggtaagtaaacgagtaccgccggtcgtcgtaggtaggaagggggatacgtttccgacccgttcgtacggaaaggggtactacggtaccctacccgaaacgtaggttggtttacggtaccttaaacgtttttaaacgaaaagtttacgggaacgacccgttaaaacccgttacggaaacccggaaacccccgggaaccgaaacccgaacgggtaaccgggtacccgtttacgttaaacttaaccgtcggaccgtaaccggagggtcccgtaaacgttcccgggtagggggaaccgtttcggaacgtcgggtaacctttagttttagggtaaaccgttttaaggggtttacggggggaccccgttaaaaggggggtaccctaaagggttaccgggttaacccgg

SEQ ID NO: 397488 - DNA, 571 bp, Homo sapiens
  misc_feature: GZ8MTXP02IHLCX.44.71.G05.1.454.CMB.2.raw
  modified_base (319)..(319): a, c, t, g, unknown or other
  modified_base (338)..(338): a, c, t, g, unknown or other
  modified_base (377)..(377): a, c, t, g, unknown or other
  modified_base (383)..(383): a, c, t, g, unknown or other
  modified_base (432)..(432): a, c, t, g, unknown or other
  modified_base (490)..(490): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtccagtgtgaagtgcagctgttggagtcgggggaggcttggtacagccggggggtcctgacactctcctgtgcagcctctggattcgcctttaatacctatgccatgatctggtcctcaggccccagggaagggctggagtgggtctcatccattactggtggtagtgccacaaatgtcgnaggactccgtgaagggccncttcatcgtcctaccaggacaattccaaagactcgggtntttacngcagactgaaagtagcctagcgagtggacgacgaccggtcctttatacngtgcctaggagggtcacgaagtaacgtaacaacaataacaagttattaacctactaanagtacgtacgtcggtacgggaaccgaaacgggccccgtacgtacctctaaccgtcacgtcctaccgaccgaacggccctag

SEQ ID NO: 397489 - DNA, 653 bp, Homo sapiens
  misc_feature: GZ8MTXP02FHOF5.44.71.G05.1.454.CMB.2.raw
  modified_base (284)..(284): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcaccatcctctgcactggaaccacagtgacgttcggtcgttttgaccgtgtctccgtggtaccagcacgaccccagaaaccncgaccccaaatcattattatgcgtacaatcgttccgccccttcggtctccctgagtccgtcttccctcgtcgggtaccaagtctggcacgccggtcctcctcgacctatcctcgtcgggcctccgagctggacgacgaggctagtattatacgtgcagtcctagtaattaacgtaacgtaaacggttacggggtaaaaccttaaccgtttttaacgtaacgtttcccggggacgacccggtaaaacgggggaaccccaaaggtccctacggtaaaccccggttacccgttaaagggcccaaaccggaaccccgaaacggggtccccttacccggtcccccccgttcgggtaccctacccgtttccccgg

SEQ ID NO: 397490 - DNA, 575 bp, Homo sapiens
  misc_feature: GZ8MTXP02IJ768.44.71.G05.1.454.CMB.2.raw
  modified_base (280)..(280): a, c, t, g, unknown or other
  modified_base (299)..(299): a, c, t, g, unknown or other
  modified_base (312)..(312): a, c, t, g, unknown or other
  modified_base (322)..(322): a, c, t, g, unknown or other
tcagacagtatatacacgaccggtgctcgatttagtgtcgtcgcaagagagaggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccacagtgacgtcggtcgttttgaccgtgtctcctggtaccagcagacccagaaacngcccccaaatcatatttangcgtcaatgttcncccttcggtntccctgagcgcttcctactggtccaagtctggctacgcgcctcctgaccatctctggctccgagctgagacgaggctgacttatactgcagctacatataacaggtaggaactacgtttaactacgtttcggacgcgaacggggaacccaaagcgtttacggaaaccccgttcgttaaacgggttccaacggtaacccccgaaaagggtcccttaccgggcccccctttacggggttccaacccgttttcccg

SEQ ID NO: 397491 - DNA, 377 bp, Homo sapiens
  misc_feature: GZ8MTXP02FX6TV.44.71.G05.1.454.CMB.2.raw
  modified_base (311)..(311): a, c, t, g, unknown or other
  modified_base (371)..(377): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaaccaacagtgacgtcggttcgtttgaccgtgtctcctggtaccagcacgaccccaagaaaccacgacccccaaatcaattattangcgtacaatcgttccgcccgttcggtcgtccctgacgcgggctcggcaaggcgacatagnnnnnnn

SEQ ID NO: 397492 - DNA, 654 bp, Homo sapiens
  misc_feature: GZ8MTXP02F74YB.44.71.G05.1.454.CMB.2.raw
  modified_base (356)..(356): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacaggccgagggcggtctctgagactctcctgtgtagtctcaggattcagttcttagtgattatcacttggcctggggtcccgtcaggctccgagggaaggggcttggagtggatctactttcgcagaaatggaaaacgttnggtaggaagtaaagagtacgcgcgtctggtagaggggaagtattcgacccgttctagaaacggggatacggtactaccgaaacgaggttgttggaccctaattttaacgaaaattcggaaacgtaccgtaaacctagaacggaccccgaacgaaccaaccgagggcctacgtattaaccgtgccgacccgagggcgaacttcccggtacggggaccgttacggaagtcggacctaagtttacgtaagttaaggtttcgggggacccgtaaagggggtacctaaaggtcggttaacccg

SEQ ID NO: 397493 - DNA, 543 bp, Homo sapiens
  misc_feature: GZ8MTXP02H18SP.44.71.G05.1.454.CMB.2.raw
  modified_base (243)..(243): a, c, t, g, unknown or other
tcagacagtatatacacgaccggtgctcgatttagtgtcgtcgcaagagagagggggggatctcaggaggcagctctctcggaatatctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttgganatataaccttgtctcctgtatacaacaacatccaggacaaacgacccccaaactctattacttttgagtccagtgagcgccgtctaggtgtttactaatcgtcttctctggtctcaagtctcggccacaccggtcctccctgtcgatcctcgtcggccttcgctggacgacgaggtctagtacttatacgtgcgtctactaactttacaacttctagacgtacgtttgggtcgttcgggcgacggtactcgaccgtcgtacccgtcgtacgtcgaccgtaccgacggtctcccgtccccg

SEQ ID NO: 397494 - DNA, 575 bp, Homo sapiens
  misc_feature: GZ8MTXP02HRMGD.44.71.G05.1.454.CMB.2.raw
  modified_base (385)..(385): a, c, t, g, unknown or other
  modified_base (407)..(407): a, c, t, g, unknown or other
  modified_base (416)..(416): a, c, t, g, unknown or other
  modified_base (489)..(489): a, c, t, g, unknown or other
  modified_base (501)..(501): a, c, t, g, unknown or other
  modified_base (524)..(524): a, c, t, g, unknown or other
  modified_base (530)..(530): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgaggccgaggggcggtctctggagactctcctgtgtagtctcaggattcagttcttagtgattatcacttggcctgggtccgcaggctccgaggggaagggcttggagtggatctactttcgcagaaatgtaaacgttatggtagaaagtaagagtacgcgngtctgtgagggagtatcacgtnacgaaggangactaccaacgtagtgttcgacctaagtttacaaagtgacgacaaaccgtgaacgacccgaacgacacgacgngtactaattacncgtccgcagggcatcgaggggcncggtancgctacttgtaagttaggttcgggacgaggggacaaggtcgtacg

SEQ ID NO: 397495 - DNA, 734 bp, Homo sapiens
  misc_feature: GZ8MTXP02FN714.44.71.G05.1.454.CMB.2.raw
  modified_base (334)..(334): a, c, t, g, unknown or other
  modified_base (421)..(421): a, c, t, g, unknown or other
tcagacagtatatacacgaccggtgctcgatttagtgtcgtcgcaagagagaggggcccagccctggggactgaacagagagaactcaccatggagtttgggctgagctggcttttcttgtggctgttttaaaaggtgtccagtgtgaagtgcagctgttggagtcggggggaggcttggtacagccgggggggtccctggacactctcctgtgcagcctctggattcgcctttaatacctatgccatgatcgtgggtccgtcgacggccccgaggggaacggggctggaggtggtctcatcctattacgtggtggtagtgccaacaaatgtcncagacctccgtaggaacggggcctcttacagttccgtccctacccgagggaactaaacttcccgaaaagtaaacttaccggggtttntttcgtacgacaagtagtagaaacgcgtcgtaggacgtaggtacggaaccgtaccgtaccggtttaccctttaagttacgtgtacgaccgtagggtacgggtaccacgtaaacgtaaacgttaaacaaaactaaagtaaacgttaaacgttaactttaactaactaacgtaacgttacggtaccggttacgggtaacggggaaacccggtaaaacccgggggtacccccgttaccgtaacccgttacccgtaacccgtacccgtaaccgtacccccgtaaccccgaaacccggtaacccggtacccctaccgg

SEQ ID NO: 397496 - DNA, 658 bp, Homo sapiens
  misc_feature: GZ8MTXP02HQEO3.44.71.G05.1.454.CMB.2.raw
  modified_base (263)..(263): a, c, t, g, unknown or other
  modified_base (269)..(269): a, c, t, g, unknown or other
  modified_base (286)..(286): a, c, t, g, unknown or other
  modified_base (307)..(307): a, c, t, g, unknown or other
  modified_base (325)..(325): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagttggctaatcttgtattttcttgtagttttttagaaggtgtcagtgtgagggcgactggcgggaggtcgggggggcttggcacgagccagggcggtctctgagactctcctgtgtagtctcaggattcagtcttagngattancacttggcctggtcctnaggctcgaaggggaacgggtntagagtgatctacttganaagtaagtagtaaacgttagaggtaaggaaagtaaacgagtaccgccgtcgttacgtaggtaagggaagggtaaatacttaccgaccgttactaacggaaaggtctaacgaccgtaaccaaagtgggttgtacgtaaccttaaagtttaaacgaaagtagaactaacgaaacgtacggaaccgaaccgaacgaacgaacgacgtacgtacgtaacgtacgtacgaccgaccgacgacgtacgtaccggtacggacgtacgtacgtacgtacgtagttagtaagttaacggttacgggtacgggtaacgggtaacggtaacggtaacggtaccg

SEQ ID NO: 397497 - DNA, 656 bp, Homo sapiens
  misc_feature: GZ8MTXP02I92G1.44.71.G05.1.454.CMB.2.raw
  modified_base (281)..(281): a, c, t, g, unknown or other
  modified_base (350)..(350): a, c, t, g, unknown or other
  modified_base (374)..(374): a, c, t, g, unknown or other
  modified_base (402)..(402): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcgggaggtcgggggggggcttgggcacgagccgagggcggtctctgagactctcctgtgtagtctcaggtattcagtcttagtgattancacttggcctgggtcctcaggctcgagggagggctggagtggatcactttcgacagaatgaaacgttanggtaggaagtaaagagtacgccgngtctggtagaggggatattccgaccgtntacgaaaggggtatacgacctacccgaaatgggttgttacggacccttaagtttaacgaaaagttggaacgtactaaaacccgtggaaaccggaacccccgaagaaccaacggaacgggccgttacctaagtttaaccgcggaccgaccgagggccgtaactcccgggttaggggaccttacgaagtcggacttagtttacggaagtttacggttcgggggacccgtaagggggtacctaaggtcggtaacccg

SEQ ID NO: 397498 - DNA, 682 bp, Homo sapiens
  misc_feature: GZ8MTXP02JD5ZM.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgagggcgactggcggaggtcggggggggcttggcacagccagggcggtctctgagactctcctgtgtagtctcaggattcagtcttagtgattatcattggcctgggtccgtcaggctccgagggagggcttgagtggatcactttcgcagtatagtaaacgttgtggtaggaaagtaaagagtaccgccgcgttctggtaggaggggaatagtttaccgaacccgttctacggaaaagggggcttacgggaaccttacccgaaaagtagggttcggtttaggggaaccccttaagtttttaaaccaaaagttcggaaacgacctaaaacccgttggaaaccggacccccgaaaggaccaacggttacgggacccttacgtaactttaccgcggcccgtaccgaggggcctaacgtcccggtaggggtacccgtgacgtcgtacttagtttacgaagtttagggttaccgggggaccaagggggtaactaacgggttccggtaccc

SEQ ID NO: 397499 - DNA, 803 bp, Homo sapiens
  misc_feature: GZ8MTXP02J2WPK.44.71.G05.1.454.CMB.2.raw
  modified_base (490)..(490): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacgagccgaggggcggtctcgtgagactctcctgtgtagtctcaggtattcagttcttagtgtattatcacgttggccgttggggtcccgtgaggcctccggaaggggacggggtcttggaggttggatccgttacgtttcggtactaaaggtaattaggtaaaacgtttagtaggggtaaaggtaaaaggttaaaacggtacggtaaccgcccggtacgttcgtaggttaagggaggggaacgtacttaccgaccgtaccgtaggaaacggggtntacgacctaccaaacgtagttcggttacgccttaaatttaacgaaagttgaaacgccgtaaaccgttacgggaaccgaacccccggtacgaacccgtaacccggaagggttcccgtaacccgttttaaatttaccccggtacggcccggttaaccccgaaagggggccccttaaacggtttccccgggacggggtaccccggttaacggtaacggtccggtaaactttaagtttttaccgggggaattttaccgggggttaccgggggaccggtaaaagggggtaacccttaaggggttccccgggttacccg

SEQ ID NO: 397500 - DNA, 582 bp, Homo sapiens
  misc_feature: GZ8MTXP02FLQQW.44.71.G05.1.454.CMB.2.raw
  modified_base (229)..(229): a, c, t, g, unknown or other
  modified_base (306)..(306): a, c, t, g, unknown or other
  modified_base (308)..(308): a, c, t, g, unknown or other
  modified_base (337)..(337): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatcctcctgcactggaaccanagtgacgttcggtcgttttgaccgtgtctccgtggtaccagcacgaccccaagaaacacgaccccaatcattattangngtcaagtcgtcgcccttcggtctccctgncgtcttcccgtcgtgggcctaagtctggcaccgaccggccctccctgacctagtctcgtcgctcccgagcgtagaggacggagctagtattagttactgcagtctacataactaagtaagtacgggtaaactactttaactacgttacggacgcgaacgggaccaaagtccgtacggaccgtaccgttacgggacacggaacccgaacggtcctaccggtcccccgtacggtccgtaccttcccg

SEQ ID NO: 397501 - DNA, 688 bp, Homo sapiens
  misc_feature: GZ8MTXP02F8RR0.44.71.G05.1.454.CMB.2.raw
  modified_base (441)..(441): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcgggagggtcggggggggggcttgggcacgaggccgaggggcggtctctgagactctcctgtgtagtctcgaggtattcagttcttagtgtattatctacgttggccgtggggtcccgtcgaggcctaccgaggggagggtcttggagtggatctactttcgcaagtaataggtaaaacgttgtgggtaaggaaagtaaagagtaccgccgtcgttctaggtaggaaggggatacttcgaacccgttntaacggaaaggggtatacgaacctaccgaaaacgtagttggttacggacctaattttaaacgaaaagttgaaacgacctaaaaccgtggaaaccggaacccccgaacgaaccaacggacggtaccgttactaacttacgcgccgacccgtagggaccgtacgtcccggtagggtaccgtcggaatcggtactagtttaggaagtttacgggttcggggaccgtaggggaaactaaggtcggtacccg

SEQ ID NO: 397502 - DNA, 628 bp, Homo sapiens
  misc_feature: GZ8MTXP02H0RGG.44.71.G05.1.454.CMB.2.raw
  modified_base (304)..(304): a, c, t, g, unknown or other
  modified_base (336)..(336): a, c, t, g, unknown or other
  modified_base (391)..(391): a, c, t, g, unknown or other
tcagacagtatatacacgaccggtgctcgatttagtgtcgtcgcaagagagaggagcccagccctggggactgaacagagagaactcaccatggagtttgggctgagctggctttttctgtggctgttttaaaaggtgtccagtgtgaagtgcagctgttggagtcggggggaggcttggtacaggccgggggggtccctgacactctcctgtgcagcctctggattcgcctttaatacctatgccatgatctgggtcctcacggccccgaggggagggctgggagtgggtctcatccattacnggtgtagtgaccacaaatgtcgcagactccgngaacgggcctcgtcatcccgtctccgagggacaattccgaaagacttacgggttntttccgagacaagataggaaagacgcctgacgaggtcggaacgaccaccgggttccccttttaagtaccgtgtacggacctaaggagggggttcacgaagggtaaactttaaacaaaactaaaattaccgaaaagtttaacttaacctaaactaactagtacggacgtcgtagggggacctaaaaccggggcccctacacccgtctcccacaccgaccctcccgaacgaacggcccc

SEQ ID NO: 397503 - DNA, 648 bp, Homo sapiens
  misc_feature: GZ8MTXP02IZKXI.44.71.G05.1.454.CMB.2.raw
  modified_base (458)..(458): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggaggtcggggggggggcttgggcacgaggccgaggggcggtctctgagactctcctgtgtagtctcaggtattcagttcttagtgtattatctacgttggcctggggttcccgtcgacgggcctccgaagggggaaggggtcttggaggtggatctacgttttcgacagtaaagttggtaaaacggtttagtggggtaggtaaagtaaaggagtaccgccgtcgtctggtaggaggggatattccaccgtctacgaagggtntagactaccaatagtgttcggacctagttaacaaattgacgacaactcgaacgacccgaacgaccacgacggacgtctacttacgacgtccgaccgaggccgtaacgtccggtagggaccggtcgagttcgacttgtttaggtaagttacggtttcggggaccgtagggggacctaaggttcggtacccg

SEQ ID NO: 397504 - DNA, 604 bp, Homo sapiens
  misc_feature: GZ8MTXP02J2TJF.44.71.G05.1.454.CMB.2.raw
  modified_base (317)..(317): a, c, t, g, unknown or other
  modified_base (412)..(412): a, c, t, g, unknown or other
  modified_base (435)..(435): a, c, t, g, unknown or other
  modified_base (445)..(445): a, c, t, g, unknown or other
  modified_base (458)..(458): a, c, t, g, unknown or other
  modified_base (527)..(527): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcgggggggggcttgggcacgaggccgaggggcggtctctgagacctctcctgtgtagtctcgaggtattcgagttcttaaggtgtatttactcacgtttggccgtgggtcccgtnaggcctccggaggggaggggtcttggagtggatctactttcgtacagtaatagaaacgttatgggtaggaaagttaacgagtaccgccgtacgtnggtaggaggggatattcgacgtnacgaaagggntcgactccaaagngttgttgacctatttaaacgaaatgacgacaaaccgtgaccgaccgacgataccgagtctactatacgngaccgcgaggtcacgtcgtaggacgtcactggactagtttcgaagttgttcgggaccgtagggacctaagcggtccg

SEQ ID NO: 397505 - DNA, 607 bp, Homo sapiens
  misc_feature: GZ8MTXP02ITE4D.44.71.G05.1.454.CMB.2.raw
  modified_base (213)..(213): a, c, t, g, unknown or other
  modified_base (230)..(230): a, c, t, g, unknown or other
  modified_base (286)..(286): a, c, t, g, unknown or other
  modified_base (310)..(310): a, c, t, g, unknown or other
  modified_base (399)..(399): a, c, t, g, unknown or other
  modified_base (464)..(464): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatcncctgcactggaaccaangtgacgtcggttcgtttgaccgtgtctcctggtaccagcacgaccccaagaaaccncgacccccaaactcaattatttangcggtcaagtcgttccgtcccctttcggtcgtcccctgacgcgtctttccgtcgtgggtaccaagttctcggacacgaccgccctcccngtacccatctcgtcgggcctccaggctggaacgggacgaggctagatttatacgtgcaagcctanatactacgaaaggttcggtaaacctcgtttaaactgttacgggcgacgtacgggaacccaaggtcctacggaccgttacccttacgggaccacggtaacccgaaacgggtcctacccggccccctcggtcctaaccgtttccg

SEQ ID NO: 397506 - DNA, 593 bp, Homo sapiens
  misc_feature: GZ8MTXP02JZUHF.44.71.G05.1.454.CMB.2.raw
  modified_base (281)..(281): a, c, t, g, unknown or other
  modified_base (301)..(301): a, c, t, g, unknown or other
  modified_base (307)..(307): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccggtctcctggacagtcagtcaccatctcctgcactggaaaccaacagtgacgtcggtcgtttgaccgtgtctctggtaccagcacgacccagaaacncgaccccaaatcattattangcgtanaatgttcgcccttcggtgtccctgacgctcttccctcgtcgggtaccaagtctcggacaccgcggccctcgctgacctatcctcgtcgggtcctccgaggtcctggacggacggaggtctagtactttattactcgcagtctacatactaaacgaaggtacggaaacttactttaacgttacgttcgggacgacgaacggggaaccctaaaggtccgtacgacccgtaccgttacggaccaaccgacccgaacggtccctaccggcccccgttcggtacctacccg

SEQ ID NO: 397507 - DNA, 731 bp, Homo sapiens
  misc_feature: GZ8MTXP02I3VYY.44.71.G05.1.454.CMB.2.raw
  modified_base (269)..(269): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggaggggtcggggggggggcttgggcacgagccgagggcggtctcgtgagactctcctgtgtagtctcaggtnttcagttcttagtgattatcacgttggccgtggggtccgtcgacggctccggaggggacgggtcttggagtggatctactttcgcaagtatacgtaaacgttatgggtaggaaagtaaacgagtaccgcgtcgttctggtagagggggtaatagttaccgaccgttctacggaaaggggtatacggacccttacccgaaacgtaggttcggttacggacctttaacttttaaaccgaaaagttcggaaacgacctaaaacccggtgaaacccggaacccccggaacgaacccgacggaacggtcccgttaacttaagtttacccgacggccgaccggacgggtccggtaaacttcccggggtaaagggggtacctaacgggtaacttcggaactttagttttacggaagtttccggtttacgggggacccgaaagggggtaacctaaggtttcggtaacccg

SEQ ID NO: 397508 - DNA, 677 bp, Homo sapiens
  misc_feature: GZ8MTXP02GZBH7.44.71.G05.1.454.CMB.2.raw
  modified_base (437)..(437): a, c, t, g, unknown or other
  modified_base (514)..(514): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggagggcgacgtgggcgggagggtcgggggggggcttggcacgaggccgagggcggtctcgtgagactctctgtgtagtctcgaggtattcgagttcttagtgtattatctacttggccgtggggtccctgaggctaccgaggggagggtcttggagtggactcgtacgtttcgacaagtaattaggaaacgttagtaggtaggaaagtaaagcgtaccgcgtcgtcgtggtaggaaggggatacgttccgaacccgtntacgaaaggggtatacgaccctaccaaagtggttcgttcggaactaagtttaacaaagttgaaacgtacctaaacgngaaaccgacccgaacaaccgcgtaaacggtccttacttacgttaccgcgggaccctacccggaggtacccgtatcccggggaggggtaaccctgaacgttgacttagtttaggaagtttcgggttacgggggaccgtaggggtaactacggttcggtaacccg

SEQ ID NO: 397509 - DNA, 660 bp, Homo sapiens
  misc_feature: GZ8MTXP02F8PBR.44.71.G05.1.454.CMB.2.raw
  modified_base (374)..(374): a, c, t, g, unknown or other
  modified_base (390)..(390): a, c, t, g, unknown or other
  modified_base (420)..(420): a, c, t, g, unknown or other
  modified_base (564)..(564): a, c, t, g, unknown or other
  modified_base (573)..(573): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgagccgaggggcgtctctgagactctcctgtgtagtctcgaggtattcagttcttagtgtattatctacgttggcctggggtcccgtcgaggtcctccggaggggagggcttggagtggatcctactttcgacagtaatgtaaacgtttgnggtaaggaagtaaagngtaccgcgtacgtctggtacgaggggtaanattcgaccgttctacgaaaggggattcgaccttacccgaaataggttcgttacggaccctaagtttaacaaaagtgacgacaacccgtaggaaccgaaccccgagaacacgacggtcccgtatacgtttacgagccccggacgnggggacccngttcccgtagggggactacgtactggtcctaagttttgaagttttacggttacgggggacctagggggaacctaaggtcgtaccccg

SEQ ID NO: 397510 - DNA, 777 bp, Homo sapiens
  misc_feature: GZ8MTXP02IPUMF.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgaggccgagggcggtctcgtgagactctcctgtgtagtctcgaggtattcagttcttagtgtatttactctacgttcggccgttcggggtcccgtcgacggtcctccggaaggggagggtcttggaggtggactctacgtttcgcaagtaatagtaaacgttagtgggtaaggtaaagtaaacgaggtaccgccggtcgttcgtggtaaggagggggtaactacgttaccgaacccgttcgtaacgggaaagggtactacgacctaacccgtaaagtgggttacggttacggacctttaaagtttaaaaccgaaagttcggaaacacccgttaaaaccgtacgggaaacccggaaacccccggaacgaaccgtacggaaacggggtccctttacgtaacgtttaccgcggaccgtacccgaagggtacccgtaacgttcccggggaacgggggtaccgttacgaagttcgggtaacctttaggtttaacggtaagtttaacgggggttcgggggaaaccggtacgggggtaaacctaggtttacccgggtaccc

SEQ ID NO: 397511 - DNA, 817 bp, Homo sapiens
  misc_feature: GZ8MTXP02GYKII.44.71.G05.1.454.CMB.2.raw
  modified_base (208)..(208): a, c, t, g, unknown or other
  modified_base (242)..(242): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcaggcacaggatcctgggctcagtctgccctggctcagcctccctcgtgtccggtctcctggacagtcgctcaccctntcctgcactggaactatactgatgttagaaaatntaaccttgtctcttaggtaccaaagtactaacccaacggtaaaaccccccaaactccttactttatagtaaacgtccaaagttaaacgccggtaccccgtacggggtactaacttttcccgtactaacgttccgtacctttctccgtaacggtccccttaccccgtaaaagtccgttacggggaaccaaacccgtaaccgggtcccttaccgggtttagtaaacgtttaaaacttttccgttacggggtacccctttacccttacgggtcccttacgggaaaccgtaaccggaacgggtaccccgtaaaacctttagtttaaacgttcggtacgttaccgtaccttaacgtaacgttacgttacgggtaccggtttaaccgttaaggttacgtttacgggtttcggggttaccggttaccgggggacggggtaccggggtacccgtccgtaccgggtaccggttaccgttaacgggtaccgtaacggtaaccccggtaacggtcccgttacccggtacccccgtaacggttaccctaccgttccgttcccggtaccccgtccctttaccgtaccg

SEQ ID NO: 397512 - DNA, 597 bp, Homo sapiens
  misc_feature: GZ8MTXP02I3U19.44.71.G05.1.454.CMB.2.raw
  modified_base (268)..(268): a, c, t, g, unknown or other
  modified_base (412)..(412): a, c, t, g, unknown or other
  modified_base (449)..(449): a, c, t, g, unknown or other
  modified_base (521)..(521): a, c, t, g, unknown or other
  modified_base (548)..(548): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgaggccgaggggcggtctctgagactctcctgtgtagtctcaggnttcagttcttagtgatttatcacttggccgtgggtccgtcaggcctccgaggggaagggtcttggagtggatctactttcggcaagtaataggtaaacgttgtggtaggaaagtaaagacgtacgcgcgtcgtgtaggaggganacgttcgaccgtcacgaagggactagactacccaagngttgttagacctatttaacaaagtgaacgccaaaccgtgaacgaccccgaagaccagacggcttctaatcgngccacaggcactccggaggcgtcagtnctagtttcgaagttacggttcggggccgtaagggacaggttacgtcccg

SEQ ID NO: 397513 - DNA, 811 bp, Homo sapiens
  misc_feature: GZ8MTXP02HJ8PW.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggaggggtcgggggggggcttggcgacgagccgaggggcggtctcgtgagactctccgtgtgtagtctcgaggtattcagttcgttagtgtattaatcacgttggccgtggggtcccgtcgacggcctccggaggggaaggggtcttggacggtggacttcgtacgtttcgacaagtaaagtaggtaaaacgtttagtgggtaaggtaaaagtaaaacggacgtaaccggccggtacgttcgtagggtagggaagggggtaagtaacttccgacccgttacgtacggaaaaggggtactacgtaacccgtacccgaaaccgtagggttacggtttacgggaccccttaaagttttaaaccgaaaagttacggaacgaaccctaaacccggtacggaaacccggaacccccggaaacggaacccaaaccgggacgggtacccgttaacttaacgtttaaccgtcggacccgtacccgaacgggtacccgtaacgtccccggtacgggggtaaccgttacggtaaacgtcggtaccttaaggtttacgtttttaacggtagggttttacgggggacccgttaaaagggggaaccttaaaacggttcggttaaccccg

SEQ ID NO: 397514 - DNA, 632 bp, Homo sapiens
  misc_feature: GZ8MTXP02GF8A6.44.71.G05.1.454.CMB.2.raw
  modified_base (416)..(416): a, c, t, g, unknown or other
  modified_base (430)..(430): a, c, t, g, unknown or other
  modified_base (442)..(442): a, c, t, g, unknown or other
  modified_base (457)..(457): a, c, t, g, unknown or other
  modified_base (534)..(534): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcgggaggtcgggggggggcttgggcacgagccagggcggtctctgagactctcctgtgtagtctcaggattcagtcttagtgtattatctacttggcctggggtccgtcgaggcctccgaaggggaggggcttggagtggatctacgtttcgtcagaatggtaaaacgttgtggtaggtaaaaggtaaaacgaggtaccgccgtacgtctaggtggaaggggaanagttcgaacccgtntacgaaagggtntagacctaccaaacngtgttcggacctaatttaacaaaagtgacgacaaaccgtgaacgaaccccgacgacaacgaggccgtactacttacngcgaccgagggacacgtccccggtaggggaccttcggattcgacttattttaggaattggtttacgggggaccaagggggtaccaagttcgggtaccg

SEQ ID NO: 397515 - DNA, 784 bp, Homo sapiens
  misc_feature: GZ8MTXP02G03PW.44.71.G05.1.454.CMB.2.raw
  modified_base (241)..(241): a, c, t, g, unknown or other
  modified_base (328)..(328): a, c, t, g, unknown or other
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatccgtgggctcagtctgccctggctcacgccctccctcggtcgtccggtctccgtggacagtcagtcacctatcctcctgcacgtacggaaaccaacngtcgtacggttcggttcgttttcgacgttgtcctccgtcggtaccacgccaaccggaccccaagaaaccaccgaaccccctaaactntaactttaatttacgtcggccgttactacgttccggttcccgtcccgtttccggtcttccccgtagaccgtccgttcctttccgtccggtccggtactacgtccgtacgacctaccgtcccggtacccttcccgaccgacctacgttccgttcccgggtcgggtccctaccgggtacggttacccgagggggtaaccggaagggtacccgggtatttacggtaatttaaaccgtcgttcgacgtacgttacccttataaacgttaaacgtaaacggtaaacgggttaccggtaaaactttaccctttaaggttaggttaccccgggaacgaacccgggtaaacggtaaaccgaacggtaccggttaaccgtacccggttaaccgtacggtccaaaccccggtaacgacccgggtaccctcccccggtccccgttacggacccttcggtttcccccg

SEQ ID NO: 397516 - DNA, 785 bp, Homo sapiens
  misc_feature: GZ8MTXP02GU41T.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcggaggtcgggggggggcttggcacgaggccgaggggcggtctcgtgagactctcctgtgtagtctcgaggattcagttcttagtgtattatctacgttggccgtcgggtccgtcgaggcctaccggaggggtaacgggtcttaggaggtggtacttccgtaacgttttcgacgtaagtaagttacggtaaaacgtttagttaggggtaacggtaaaaggtaaacggtacggtaaaccggcccggtacggttacgtaggtagggaacggggaaacgttacgttaccgtacccgttacgtacggaaaaggggtctaacgtaaccttaaccccgaaagtacgggtttggttacggaacccttaacgttttaaacgaaaagttcgaaacgtaccctaaaaccgtacgggaaacccgaacccccggaacgaaacccacggaagggtacccttacgttaacttaccgtacgcccggaccgaggggacccacgttaccccggtaggggtaccgttaccgacgttacgacgtttagtttacggtaagtttacggggtttaccggggaccgtaaaggggtactaaacggttcggtaacccg

SEQ ID NO: 397517 - DNA, 749 bp, Homo sapiens
  misc_feature: GZ8MTXP02JVILS.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggagggcgacgtgggcggagggtcgggggggggcttgggcacgaggccgaggggcggtctcgtgagacctctcctgtgtagtctcaggtattcagttcttaggtgtatttatctacgttggccgttcggggtccgtcgaggtcctaccggaagggggaagggtcttaggaggtggactccgtacgtttcgcgtaagtaatacggtaaacgttagtaggtaaggtaaagtaaacggtacgtacgccgtcgtacgtaggtaggaacggggtatacgttaccgaccgtactacggaaaggggtctacggtaaccttacccgaaaagtcggttagttaccgggacccttaaagtttaaacaaagttacgacgtaccgtaaaacccgtggaaacccggaaccccggaacgaaccaaccggagggtacccgttacgttaactttacgcggacccgacccgagggtaccgtaacgttcccgggtaggggtacccgtcgaagtccggtacttaggtttaggtaacggttaacggttttcgggggaaccggtaacggggtactaacggttcggttacccg

SEQ ID NO: 397518 - DNA, 707 bp, Homo sapiens
  misc_feature: GZ8MTXP02GQYWW.44.71.G05.1.454.CMB.2.raw
  modified_base (327)..(327): a, c, t, g, unknown or other
  modified_base (403)..(403): a, c, t, g, unknown or other
tcagacagtatatacacgaccggtgctcgatttagtgtcgtcgcaagagagaggagcccagccctggggactgaacagagagaactcaccatggagtttgggctgagctggctttttcttgtggctgttttaaaaggtgtccagtgtgaagtgcagctgttggaggtcggggggaggcttggtacaggccgggggggtccctgacactctcctgtgcagcctctggattcgcctttaatacctatgccatgatcgtgggtccgtcgacggccccgaggggaagggctgggagtgggtctcatccattacgtggtggtagtcgccaanaaatgtcgcagcctccggtgaacgggcctcttcatcccgtctccgagggacaattccaaagtattacggtgtttcngcagactgaaagcgccgtgacgaggtggaacgaccgtaccggttaccctttatacgtgtacgaccgaagggtacggggtcgacgtaaagggtaaacgttaaccaaaaactaacttaaacgtaaaagtttaactttaaaccgtaaaccttaaacgtaaagttacggggtaaaccggttccggggttaacgggggaaacccgtaaaaacccgggggtaccccccgtaccgtaaccccggttcccttaccccgttaccgaacccgtcccccgtaaccccgaaacccgggtaaaccggggtccccccg

SEQ ID NO: 397519 - DNA, 772 bp, Homo sapiens
  misc_feature: GZ8MTXP02JCK9N.44.71.G05.1.454.CMB.2.raw
  modified_base (223)..(223): a, c, t, g, unknown or other
tcagacagtatatacacgaccggtgctcgatttagtgtcgtcgcaagagagaggaggggggggatctcaggaggcagctctctcggaatatctccaccatggcctgggctctgctcctcctcaccctcctcactcagggcacaggatcctgggctcagtctcgccctggctcacgccctccctccgtcgtccgggtctcctggacagtcagtcaccatctccngcacgtagaaaccacgagtcgacggttcggttcgtttcgccgtcgtcctcctacggtaccacgccacgaaccccaacgaaaccaccgaacccccaaacttacctatttaactttacgtcgtccggtactaacgttcggttcccgtcccgtttcggtccgtcctgacgtcgtccctttcgtcgtcgtacctaagtccgtacggtccaaccgtacccggtccctcccgtacgacctacgttcctacgtcgggacccttccggaggtacgtacgggacgggacccgggtaaggtcgttacgtaaacgttttacgttaccggtagtacccgtacggttaccttacctaaacgttttaaacgaaaccggtaaaacggggtttaacgggtaaacctttaaaaccgttttacggttaaacggttcccgggtaaccgaccggggtaacggggtaaacctaaccggtaccttaacccggtaccggttaacccgtaacggtaccgaaccggttaccccgaacgggtcccgtaccccgcccgttaccggtactttccccg

SEQ ID NO: 397520 - DNA, 731 bp, Homo sapiens
  misc_feature: GZ8MTXP02I5MA2.44.71.G05.1.454.CMB.2.raw
  modified_base (386)..(386): a, c, t, g, unknown or other
  modified_base (431)..(431): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctcgtgagactctcctgtgtagtctcgaggtattcagttcttagtgattatcacttggcctgggtccctcgaggctccgagggagggcttggagtggatctactttcgacagtaataggtaaacgttgtgggtaggtaaagtaaaggngtaccgccgtcgttcgtggtagagggggtaatagttccgaccgtntacgaaaggggtactacgaccttaccgaaacgtaggttcggttcggacccttaatttaaaccaaaagtcggaaacgaccgtaaaaccgtggaaacccggaacccccggaacgtaaccaacggacgggtccgttaccttaaggtttaccgagggccccgaacgtacggggtacccgtacgttccccgggtagggggtaacccggttcgaaacgttcggtaccttaaggttttacggaacggtttaacgggtttcggggggaacccgtaagggggtaacctaaacgggtttccgggtacccg

SEQ ID NO: 397521 - DNA, 725 bp, Homo sapiens
  misc_feature: GZ8MTXP02HDMI1.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctcgtgagactctcctgtgtagtctcgaggtattcagttcttagtgtattatctacgttggccgtgggtccgtcgaggtctccgaggggaaggggtcttggaggtggactcgtacgtttcgacaagtaatagtaaacgttagtagggtaaggtaaagtaaaagacggtaccggccggtcgtacgtagggtacgggaaggggaagtacgttaccgaccgtcgtacgaaaggggtatacgacttacccgaagtaggttcgttacggaccttaaatttaacgaaaagtcggaacaccgtaaaccgtaggaaaccgaacccccggaagaacccgaacggtaacgggtcccgttaactttaacgttaaccggcggacccggtaccgagggtaccgtaacgttccccgggtagggggtaccctcggtaatcggtacttaggttttagaagtttacggttcgggggactaagggggacctaagggtcgtacccg

SEQ ID NO: 397522 - DNA, 704 bp, Homo sapiens
  misc_feature: GZ8MTXP02IGJY9.44.71.G05.1.454.CMB.2.raw
tcagacagtatatacacgaccggtgctcgatttagtgtcgtcgcaagagagaggagcccagccctggggactgaacagagagaactcaccatggagtttgggctgagctggctttttctgtggctgttttaaaaggtgtccagtgtgaagtgcagctgttggaggtcggggggaggcttggtacaggccgggggggtccctgacactctcctgtgcagcctctggattcgcctttaatacctatcgccatgatcgtggggtccctcgacggccccgaggggaacgggctgggagtgggtctcactccattacgtggtggtagtcgacctacaaagttcgtcgacacggaccgtcggtaggaacggggcctctcgactccgtcctccgaagggtactaacgttaccgaaagtaacgttcggttagtttcgtagtcgaaggtactaggaaagcgcccgtagcggtaggtcggaacgaccgtaccgggttcccttttaagtacgtggtacgtacccgaggtacggggtcgacgtaaggtaaacgttaacaaacgaaatacgtaaaagttacttaaccgtaactacctaaggtcggtaaaccggtcgggtaacggggaacccgtaaaaccgggggtcccccggtacgtaacccggtccttacccgtacgtaccggccccttaacccgaacccgggaacggtacccccg

SEQ ID NO: 397523 - DNA, 737 bp, Homo sapiens
  misc_feature: GZ8MTXP02GL2KR.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcgggggggggcttgggcacgaggccgagggcggtctcgtgagactctcctgtgtagtctcaggtattcagttcttagtgattatctacgttggccgtggggtcccgtcgacggcctaccgaggggagggcttggagtggatctacgtttcgacagtaataggtaaacgttagtaggtaaggtaaagtaaacggacgtaccgccggtcgtcgtaggtaggaaggggatacgttaccgaccgtcgtacgaaagggctacgacctaccaaagtggttcgttacgaccctaattttaacgaaaagttggaacgtacctaaaccggtgggaaaccgaacccccggaacgtaaccgacggtacgggtaccgtttacttaaacgtttaccgtcggacccgacccggtaggggtacccgtaacggttccccggtagggggtaacccgtaccggtagttaccggaccgtttaagtttacgggaagttttacgggtttaccgggggacccggtaagggggtaacctacgggtttacggtaccccg

SEQ ID NO: 397524 - DNA, 596 bp, Homo sapiens
  misc_feature: GZ8MTXP02H7YSO.44.71.G05.1.454.CMB.2.raw
  modified_base (273)..(273): a, c, t, g, unknown or other
  modified_base (323)..(323): a, c, t, g, unknown or other
  modified_base (339)..(339): a, c, t, g, unknown or other
  modified_base (382)..(382): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttcttgttagttttttagaaggtgtccagtgcgaggggcgacgtggcgggaggtcggggggggggcttgggcacgagccagggcggtctcgtgagactctctgtgtagtctcaggattcagtcttagngattatcagttggcctgggtccctgaggctccgaaggggaaggcttaggngtggatctacttcganagtaaatagtaaacgtagtggaggaaagtaaagagtacgccgngtatgtgaagggatagttcacgtctcgaaagtgaattacgaactaccaactaggtgttacgacctaatttaacaaagttgaagaactacagacgaccaacgacacgagtaccgtactaattacgacgccgacgaacgcgaacgtccgtaggacgtccggtaatcggactagttgtactaggtttacggaccggttaaggaacgtaagttccggg

SEQ ID NO: 397525 - DNA, 662 bp, Homo sapiens
  misc_feature: GZ8MTXP02ICIOX.44.71.G05.1.454.CMB.2.raw
tcagacagtatatacacgaccggtgctcgatttagtgtcgtcgcaagagagaggggggggatctcaggaggcagctctctcggaatatctccaccatggcctgggctctgctcctcctcaccctcctcactcagggcacaggatccgtgggctcagtctgccctggctcacgccctccctccgtcgtcccgggtctccgtggacagtcagtccaccatcctctgctacgtacggaaaccaagaggtcgacgttcggttcgtttcgaccgtgtctcctaggtaccagccacgacccaagaaaccaccgaaccccctaaactctaatttatttacgcggtacgtactagttcgttcccgtccccgttcgggtactccccgtagacgtctcttcccgtcgtcggtaccagtcgtacgaccacgtcccgccctccgtacacctatccgtcgtccgggtctacccggaggtccgtaggaccggagaacggtcgtaagttacttacgttcgtcggactacgtctacgtaagtacgtaaacgtacggtaacgtaacttacgttaacgtacgtcggacgacgaacggtacacggtcgtacgtaccgtccggtaacgtccgtaccgaaccggacgtaccgtcccgtaccccgtcgtaccctaccgttcccg

SEQ ID NO: 397526 - DNA, 700 bp, Homo sapiens
  misc_feature: GZ8MTXP02II6ER.44.71.G05.1.454.CMB.2.raw
  modified_base (241)..(241): a, c, t, g, unknown or other
  modified_base (266)..(266): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggaggtcggggggggcttgggcgacgaggccgaggggcggtctcgngagctctcctgtgtagtctcaggtnttcagttcttagtgtatttatctacgttggccgtcgggtcccgtcgaggtccctaccggagggggtaaggggtttgaggtaggtacgtactacgtttcgtacgtaagtaaagtacggtaaacgttagttaggggtaggtaaaaggtaaaggtacggtacggccgtcgtacgttaggtaggaagggtaggtattcgaccggtcgtacgaaggcgtagacccgtacaacgtagtcggtacgacttaaatttacgaaatcgtaagacctaccgtaagacccggaaaccgacgaaccgaaactcgggaaccgttactaagttacgcgacccgggccaggggtccgacgttccgaggggacctagtacgtcgcgttaagtttgtagttcgggttacggggaccggaggggtaaaactcggtttaccggctttaaccccg

SEQ ID NO: 397527 - DNA, 753 bp, Homo sapiens
  misc_feature: GZ8MTXP02I9XHX.44.71.G05.1.454.CMB.2.raw
  modified_base (265)..(265): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgactggcgggaggtcgggggggggcttggcacgaggccgaggggcggtctctggagactctcctgtgtagtctcaggtnttcagtcttagtgtattatcacgttggcctggggtccctcgacgggcctccggaaggggtaacggggtcttgggaggttcggacttaccgtacgttttcggtacgaagtaagttacggtaaaacgtttagtggggtaaggtaaaaggtaaacggagtaccggccgtcgttgtaggtagggagggggtaactagttacccgaccgttacgtaacggaaagggggtacttacggaaccttacccgtaaacgtaggttaggttacggtaacccttaagtttaaaccaaaagttcggaaacgtacccgtaaacccgtacggaaaccgggaacccccggaaacgaaccccaacggacgggtacccttaccgttaatttacccgcggtaccgaccgtaaggcccgtaacgttccccgggtagggaaccgttcgagttcgtactagtttagaagtttacggttacggggaccgtaagggactacggtacgtcccg

SEQ ID NO: 397528 - DNA, 778 bp, Homo sapiens
  misc_feature: GZ8MTXP02GIXDZ.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaggtgtccagtgcggaggggcgacgtgggcgggagggtcggggggggggcttgggcacgaggccgagggcggtctcgtgagactctccgtgtgtagtctcaggtattcgagttcttaggtgattatcacgttggccgttggggtcccgtcgaggcctccggaaggggaacggggtcttagggaggtggacttccgtaccgttttcggacaagggtaattaggtaaaacggtttagtaggggtaaggtaaagtaaaacggacggttaaccggccggtacggttacgttaggttacgggaagggggtaagtacgtttacccgaacccggttcgtacggaaaacgggggtacttacggtaacccttaacccgaaaaccgtagggtttacggttcggggaacccttaaagttttaaaccgaaaagttcgggaacgtaacctaaacccgtaggaaccggaacccccggaacgaaccacggtaacggtccgttactaagttcctacggcccgaccggtaagggcctacgtccccggtagggggtacctaccgatcggaccttagtttacgaagttacggtttcggggaccgtaagggggtacctaagggttcgtacccgg

SEQ ID NO: 397529 - DNA, 813 bp, Homo sapiens
  misc_feature: GZ8MTXP02IY7C8.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactgggcgggaggtcggggggggcttgggcacgaggccaggggcggtctctgagactctcctgtgtagtctcaggattcagttcttagtgatttatcacgttggcctgggtccgtcaggcctccgaggggagggcttggagtggatcgtactttcgacagtaatagaaacgttagtggtaaggaagtaaaggagtacgccgcgtctggtagaggggaagtattaccgaccgttctaacgaaaggggtactacggaaccttacccgaaaacgtggttacgttacggggtacccttaagtttttaaaccgaaaagttacgggaaacgtaaccctaaaaccccggttagggaaacccgggaaaccccccggtaacggaaaccccgtaaacccgggaacggggttaccccggttaaccgtttaaacgtttaaccccggtccgggacccgggttaccccgaaacgggggtcccgtaaacgtttccccgggtacggggggtaacccttaccggggtaaatttcgggtaacccttaaaggttttttaccggaacggtttttaaagggggtttccggggggaacccgttaaaagggggggacccctttaaaaggggtttccggggttaaacccccg

SEQ ID NO: 397530 - DNA, 544 bp, Homo sapiens
  misc_feature: GZ8MTXP02JF3JU.44.71.G05.1.454.CMB.2.raw
  modified_base (310)..(310): a, c, t, g, unknown or other
  modified_base (397)..(397): a, c, t, g, unknown or other
tcagacagtatatacacgaccggtgctcgatttagtgtcgtcgcaagagagagggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaaccacagtgacgtcggtcgtttgaccgtgtctcctggtccagcacgacccccaagaaaccacgcccccaaaatcctaattatttangcggtcaatgttccgccctttcggtgtcccctgacgcgtcttaccctcgtggtccaagttctggacacgacggtccctccctgaccntctctggctccaggctgaggacgaggctgattatactgcagtctcaatactacaagtggtaactactttactagttcggcgctaacgggacaagcgtcgaccgtcacggtcacgccgaaggctcggaccccctcggtaccacgttcg

SEQ ID NO: 397531 - DNA, 728 bp, Homo sapiens
  misc_feature: GZ8MTXP02FTWAB.44.71.G05.1.454.CMB.2.raw
  modified_base (274)..(274): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggttctcgtggagactcctccgtgtgtagtctcgaggtnttcagttcttagtgtattatctacgttggccgttggggtcccgtcgacggcctaccggaggggtaacggggtctttgggaggttggacttcctacgttttcgacaaggtaataggtaaaacgttgtaggggtaggaaagtaaagacgtaccgccggtacgttcgtaggtagggaaggggaatacttaccgaccgttctaacggaaaggggtactcggaaccttacccgaaagtggttgtttacggacccttaaagttttaaacaaaagttgaacgaccaaaaccgttggaaaccgtaacccccgagaaccgacgacgggtaccttacttaacgttccgtacggcccgaccgtagggacccgtaacgtcccgggttagggaccgttcgattcggacttagtttaggaagtttacgggttacggggaccgaaggggtacctaaggttcggtacccg

SEQ ID NO: 397532 - DNA, 750 bp, Homo sapiens
  misc_feature: GZ8MTXP02F2192.44.71.G05.1.454.CMB.2.raw
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggaggtcggggggggggcttgggcacgaggccgaggggcggtctcgtgagactctcctgtgtagtctcgaggtattcgagttcttagtgtattatctacgttggcccgtggggtcccgtcgacggcctaccggaggggaacggggtcttgggagtggatccgtacttttcggtacaagtaataggtaaaacgtttagtagggtaagggaaaagttaaacggacggtaccgaccggtacgttcgtaggtaagggaagggggtaaatacgtttaccacccgttcgtacggaaagggtactacgacccttaccaaacgtaggttcgttacggaccctaagtttaacaaaagtgaacgtacaaaacccgttggaaacccggacccccgtaagaaccctacgggagtacccgttattaacgttaccgtgggacccgaccgtaagggcccgtacttcccgggtagggggaccgttcgtaaattccgggaacttggtttaggaacgtttaggggtttaccgggggacccgggtaaagggggtacctaaggttccggtacccg

SEQ ID NO: 397533 - DNA, 651 bp, Homo sapiens
  misc_feature: GZ8MTXP02HGLL8.44.71.G05.1.454.CMB.2.raw
  modified_base (429)..(429): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgtagttttttagaaggtgtccagtgcgagggcgactggcgggaggtcggggggggcttggcacgagccgagggcggtctcgtgagactctcctgtgtagtctcaggattcagtcttagtgattatcacgttggccttggggtcccgtcgaggcctccgaggggaaggggtcttggacggtggattcgacgttttcgacagtaatagtaaacgttagtgggtaggtaaagtaaaggtacgtaccgccgtgtcgtggtagaggggtatacttcgacccgtntacgaaagggattagactaccgaaagtggttagttacggactaacgtttaacaaaacgtgaacgtaccaaaccgttaggaaccgacccgaacggaccacgaacggtcgtatacgtacttcggactacccgaggcgtacggtcccgttaggggacctcggatcggtacttgttcgaagtttacggtcggggtaccgaagggggtacctaaggttcggtacccg

SEQ ID NO: 397534 - DNA, 575 bp, Homo sapiens
  misc_feature: GZ8MTXP02H8TYX.44.71.G05.1.454.CMB.2.raw
  modified_base (370)..(370): a, c, t, g, unknown or other
  modified_base (395)..(395): a, c, t, g, unknown or other
  modified_base (406)..(406): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggggcttgggcacgagccagggcggtctctgagactctcctgtgtagtctcaggattcagtctagtgattatcacttggcctgggtcccgtacaggctccagggagggtctggagtggatcactttcgtcagatgaaacgttatggtaggaagtaaagagtacgccngtctaggtgagggagtatcaccgtntcgaaagggtntgactccaacagtgtagcattaacaatgagacactgacgacgacgtacacaggcgtactatttacgcgacgaccgaggccgtaatcccggtacgggacgtaccggtaatcgacgtactttagaagtttacgttacgggggcctaaagggggacctaaaggtcggtaccg

SEQ ID NO: 397535 - DNA, 770 bp, Homo sapiens
  misc_feature: GZ8MTXP02GU6VJ.44.71.G05.1.454.CMB.2.raw
  modified_base (270)..(270): a, c, t, g, unknown or other
  modified_base (480)..(480): a, c, t, g, unknown or other
tcagacagtatatacacgaccggtgctcgatttagtgtcgtcgcaagagagaggagccccagccgtgagattcccaggagtttccacttggtgatcagcactgagcacagaccaccaaccatggagtttgggctaatcttgtattttccttgttagtttttttagaaggttgtccagtgcggaggggcgacgtgggcgggagggtcggggggggggcttggcacgagccgaggggcggtctctgagactctcctgtgtagtctcgaggtnttcagttcttagtgtatttatctacgttcggccgtcggggtcccgtgacggtccgtacggaggggaaggggtcttgggaggtcggatccgtactttcggactaagtaagtacggtaaacgtttagtagggtaaggtaaaggtaaacggacgtacgtccgtcgttcgtaggtaggaggggtaatacttaccgaccgtacacggaaagggtntacgacctacgaagtaggttggttacgaccttaagttaaacgaaagtcgaaaccgtaccgtaaacccgtaggaaacccggtaaccccggaacgaacccgtaacgggtaccgggtacccgtttacttaacgtttaaccggtccgacccccggtaccgggaacgggtaccgtaaaccggtttcccggggtaaggggaccggttacgtaagtccgttacgttagtttaaggtaacggtttaacgggttccgggggaacgtaacgggggtaacacggggtttacccggtacccg

SEQ ID NO: 397536 - DNA, 543 bp, Homo sapiens
  misc_feature: GZ8MTXP01CEO04.38.22.B11.1.454.CMB.2.raw
  modified_base (197)..(197): a, c, t, g, unknown or other
  modified_base (293)..(293): a, c, t, g, unknown or other
  modified_base (357)..(357): a, c, t, g, unknown or other
  modified_base (369)..(369): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgttagcagcaacttagcctggtaccagcagaaacctggccaggctcccaggctcctcatctatggtncatcccaccgagggcccacgtggtactcccagccagggtcagtggcaggtgggtctaggggacnggagttcactcncaccatcagcagctgcagtctagagtatttgacttagtttattctggtctagtctaattacaattcgtcggtcccttacgtacggtggaccgttcgggccgaaggggaccgaaagggttaggaaacttcgaaaacgacttgggtcggactcggactaccgattccgttcgttcc

SEQ ID NO: 397537 - DNA, 552 bp, Homo sapiens
  misc_feature: GZ8MTXP01CVUG2.38.22.B11.1.454.CMB.2.raw
  modified_base (197)..(197): a, c, t, g, unknown or other
  modified_base (291)..(291): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcagcaacttagcctggtaccagcagaacctggccaggctccaggctcctcatctatggtncatcccacgagggccacgtggtactcccagccagggtcaggtggcaggtggggtctagggggacaaggtacgtttccacgttcctccaaccatccagcacgcctgcagtctagaagtattttgctagtttattctggtcagtctaattaactaattcctcggtcccttcgtacgtggtaccggttcggaacccgaagggggaccaagggttacggaaactcgaaaacgttcttggtaagtctcggcaccgatcgttgttcc

SEQ ID NO: 397538 - DNA, 625 bp, Homo sapiens
  misc_feature: GZ8MTXP01B4I7V.38.22.B11.1.454.CMB.2.raw
  modified_base (197)..(197): a, c, t, g, unknown or other
  modified_base (294)..(294): a, c, t, g, unknown or other
  modified_base (433)..(433): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggctagtcagagtgttagcagcaacttgcctggtaccagcagaacctggccagactcccaggcctcctcatctatggtcncactcccaaccgacggggccacgttggtactccccgagcccgaggggtccaggtcggcgtagggtcggggtcctagggggaaccaagggtacgtttccaccttcctacaacctatccagcacgctgcagtctagtaatntttgcttagtttatttctggtctagtctaatttacaactttacgtcggtacccttccgttacggtcggtaccggtttcccgggaaccgtaagggggttaccctaaaggggttacggtaaaacgttaccgaaaacggttacgttacgggtaacggtccgttcggaccctaccgttacttcgttaacgtttccc

SEQ ID NO: 397539 - DNA, 546 bp, Homo sapiens
  misc_feature: GZ8MTXP01A4RD9.38.22.B11.1.454.CMB.2.raw
  modified_base (197)..(197): a, c, t, g, unknown or other
  modified_base (275)..(275): a, c, t, g, unknown or other
  modified_base (285)..(285): a, c, t, g, unknown or other
  modified_base (352)..(352): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgtagcagcaattagcctggaccagcagaacctgcaggctccagctctnatctatggtncatcccacgagggcctagtggtactcccgagccgagggtcaggtcggcgaggtgggtctaggggacnggcgttccactcctcgaacctagtcagcagcctgctagtctagtaaagtattttcgattaagtttattattgggtacagtcagtatgatcagtcgtcctcgtactctaaccgttcgggacgtaacggggaccaacggtacgttacggaacaaaacgtaaaacggacgtggtcggcttacgccttaaccgtaacg

SEQ ID NO: 397540 - DNA, 517 bp, Homo sapiens
  misc_feature: GZ8MTXP01DJL4R.38.22.B11.1.454.CMB.2.raw
  modified_base (196)..(196): a, c, t, g, unknown or other
  modified_base (282)..(282): a, c, t, g, unknown or other
  modified_base (292)..(292): a, c, t, g, unknown or other
  modified_base (354)..(354): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggctagtcagagtgttagcagcaacttagcctggtaccagcagaaacctggccagactccaggctcctnatctatggtncatcccacgagggccactggactccccagccgagggtcaggtggcaggtgggtctggggacngagttcactctcacatcagcagcctgcagtctgaagtatttgacttagtttattcgtgtcagtctattacattacgtgtcctcgtacgtgtacgttcggcgtagggaccaagggttgaaatcgaaacgttacttggtaacggctcgcctacatcgttcgttcc

SEQ ID NO: 397541 - DNA, 586 bp, Homo sapiens
  misc_feature: GZ8MTXP01D5B40.38.22.B11.1.454.CMB.2.raw
  modified_base (199)..(199): a, c, t, g, unknown or other
  modified_base (335)..(335): a, c, t, g, unknown or other
  modified_base (451)..(451): a, c, t, g, unknown or other
  modified_base (561)..(561): a, c, t, g, unknown or other
  modified_base (574)..(574): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaangccaccctctcctgcagggccagtcagagtgttagcagcaacttagccctgggtaccacgcacgaaacctaggccaacggctcccaacggctccctcatctatcggtgcactcccaccgacggggccacctggtancccctaacgcccgagggtacctaggtgggacgaggtaggggtcgtaggggaccgtaaggtagtttccaacctcctacaccaattcaggcaggccctggccagtctgtaagattttnactaactttatttactggtactaaagtatctttaaatacgttaattctactacgtttcgggacgggaacggaccgaaaggtcgagtacagaaaccgtattgttcggctgnaaccctgtacttnttcttcttaacc

SEQ ID NO: 397542 - DNA, 669 bp, Homo sapiens
  misc_feature: GZ8MTXP01D7QTN.38.22.B11.1.454.CMB.2.raw
  modified_base (198)..(198): a, c, t, g, unknown or other
  modified_base (294)..(294): a, c, t, g, unknown or other
  modified_base (306)..(306): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggaagaaatagtgatgacgcagtctccagccaccctgtctgtgtctccgaggggaaancgcccaccctctcctgccgagggccagtcagagtgttagcagctaacttgccttaggaccagacaagaaacctggccaggcctccgaggcctcctnatctagtggtcncactcccaacgacgggccacgtggtactcccgagccgaggtcaggtggacgtagggtcgggtcgtaggggaacctgggtacgtttccaccttctaccaaccgtatccaagccacgtcctaggcctaaggttctaggtaaagttgttttcgactttagttttactttcgtgggtactaagttacttaactttaactaactttccggtcggtacccctttaccgtaacggggttccgggtacccggtttccgggggaaacccggttaacgggggaaacccgttaaaggggttaacgggaaaaaccttacgttaaaaccgggttacgttgggtaacggcttcggacctacattcgttaacggttcc

SEQ ID NO: 397543 - DNA, 535 bp, Homo sapiens
  misc_feature: GZ8MTXP01EB2W3.38.22.B11.1.454.CMB.2.raw
  modified_base (195)..(195): a, c, t, g, unknown or other
  modified_base (290)..(290): a, c, t, g, unknown or other
  modified_base (358)..(358): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaangcccacctctcctgcagggccagtcagagtgtagcagcaattagcctggaccagcagaaacctggccaggcctccaggcctcctcatctatggtncactccacgagggccacgtggtactcccgagccgaggggtcaggtggcagggtcgggtctaggggacnggtacgttcacttctaccacatcagcacgcctgcagtctagtaagttatttgacttaagttttattagttcggtactagtctagtatgatcgagtcgtcctcgatccaaccgtcggcgagggacacggacgttggaacttaaagtaaacgagtggtacggcttacgccttaacgtaa

SEQ ID NO: 397544 - DNA, 554 bp, Homo sapiens
  misc_feature: GZ8MTXP01EROHN.38.22.B11.1.454.CMB.2.raw
  modified_base (197)..(197): a, c, t, g, unknown or other
  modified_base (285)..(285): a, c, t, g, unknown or other
  modified_base (295)..(295): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcagcaacttagcctggtaccagcagaaacctggccaggctcccaggctcctnatctatggtncatccacagggccacgtggtactcccagccgaggggtcaggtcggcagggtggggtctaggggactaaggagttccacttctaccacatcagcagcctgcagtctagtaagtatttgcttaagtttattagtttgggtctaagtctaagttatgtattcgaaggtcggtcctcgacttccgaaccgttcggaccgagggggaccacggacttagggaacaaacgtaaacgaacgtggcggtcttcgaacttaaccgtaa

SEQ ID NO: 397545 - DNA, 512 bp, Homo sapiens
  misc_feature: GZ8MTXP01BESOY.38.22.B11.1.454.CMB.2.raw
  modified_base (195)..(195): a, c, t, g, unknown or other
  modified_base (279)..(279): a, c, t, g, unknown or other
  modified_base (310)..(310): a, c, t, g, unknown or other
  modified_base (414)..(414): a, c, t, g, unknown or other
tcagtcgatcacgtcacgaccggtgctcgatttagacgacagctcagggggaggaactgctcagttaggacccagacggaaccatggaagcccagcgcagcttctcttcctcctgctactctggctcccagataccactggagaaatagtgatgacgcagtctccagccaccctgtctgtgtctccaggggaaangcccaccctctcctgcagggccagtcagagtgttagcagcaacttgcctggaccagcagaaacctggccaggctccagactccnatctatgatgcatccacagggcccatggtcncccagccaggttcaggtggcaggtgggtctgggcagagttcactctcaccatcagcagcctgctagtctgaagtatttgctagtttattagttgtcagtcagtntgatcgtagtcggcctcgtatccgtaccgttcgggacccttaggggaccacgacgttgggaactaaagtaaacgaacgtggtacggactcgcgtaacc

SEQ ID NO: 397546 - DNA, 598 bp, Homo sapiens
  misc_feature: GZ8MTXP01DGDTZ.38.22.B11.1.454.CMB.2.raw
  modified_base (201)..(201): a, c, t, g, unknown or other
  modified_base (309)..(309): a, c, t, g, unknown or other
  modified_base (386)..(386): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggcctcccagataccactggagaaatagtgatgacgcagtctccagccaccctgtctgtgtctccgaagggggaaangcccaccctctcctgccagggccagtcagagtgtagcagcaacttagccctaggtaccagcaacgaaacctggaccaggcctcccgaggcctcctcatctatgggtcncactccaaccgaggggccccacgtggtactcccgacgcgagggtcaggtggacgtaggtcggggtcgtaaggggacnggtacgtttccaactctaccaccatccgagctacgcctgctagtctaggtaatatttgacttagttttattcgttggtacagtactattaactaattacgtcgtacccttcgtacggtcggtaccgttcgggaaccgtacggggaaccgtaaaggttaggtaaactcgaaaacggcgttagtcgggctaagccacttattcgttcgttaacc

SEQ ID NO: 397547 - DNA, 595 bp, Homo sapiens
  misc_feature: GZ8MTXP01BJBI7.38.22.B11.1.454.CMB.2.raw
  modified_base (198)..(198): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccacccctctcctgcagggccagtcagagtgttagcagcaacttagcctggtaccagcagaacctggccaggctcccgaggcctcctcatctatggtcgcatcccaccgagggccctacgtggtactccccgagcccaggggtcacggtggcaggtggggtctaggggacaaggtgttccactcctcacatccagcaggcctagctagtctaggtaagtgttttgcttagttttatttccgtgggttcagtctaagtttacaagtttcgtcggtacccttccgtacggtcggtacgttccgggccgaacgggggttacctaaagggttacgtaaacgtaccgaaaacggttacgttacggttgggacctcggccaccttagttccgttcgttaacc

SEQ ID NO: 397548 - DNA, 550 bp, Homo sapiens
  misc_feature: GZ8MTXP01BSM0R.38.22.B11.1.454.CMB.2.raw
  modified_base (198)..(198): a, c, t, g, unknown or other
  modified_base (279)..(279): a, c, t, g, unknown or other
  modified_base (287)..(287): a, c, t, g, unknown or other
  modified_base (295)..(295): a, c, t, g, unknown or other
  modified_base (309)..(309): a, c, t, g, unknown or other
  modified_base (344)..(344): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccacctctcctgcagggccagtcagagtgttagcagcaattagcctggaccagcagaacctggccaggctccagctccnatcatgtncatccacngggccactggtacnccagccagggtcagtggcaggtgggtcaggggacnggtattccactcctacaacctatcaacgcagccctgaccagttcgtagtaagtattttgcttagtttatttctaggtcagtctaattacaattacgtgtacccttctacggtgtaccgttcggaaccgaggggacctaaagggttcggaaaatcgaaaacgttcgttggtaacgtcgtggaccaccgttaagttccttcgttaacc

SEQ ID NO: 397549 - DNA, 682 bp, Homo sapiens
  misc_feature: GZ8MTXP01CGPGK.38.22.B11.1.454.CMB.2.raw
  modified_base (198)..(198): a, c, t, g, unknown or other
  modified_base (208)..(208): a, c, t, g, unknown or other
  modified_base (293)..(293): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangcccaccctntcctgcagggccagtcagagtgtagcagcaattagcctggaccagcagaacctggccaggctccgaggctcctcatctatggtcncactcccaaccgagggcccctacgtggtactccccgagcccgaggggtcaggtcggcgtaggtcggggtctagggggaactggtacgtttccaacgttcctaccaaccctagtccgaacgccaacggtcccttaggacctaaggttaccgttaaggtaaagtttacgtttttggactttaaggtttttactttccgttaggggtactaagttacttaatttaacctaatttaccgtcggtacccttcgtaacgggttcggtaaccggttcgggaaccggtaacgggggaacctaaagggttaacgggaaaactaaccggttaaaacgttacggttacgggtaacggtacgtaaccggtaccgtacccttagttccgttcggtttaaccc

SEQ ID NO: 397550 - DNA, 707 bp, Homo sapiens
  misc_feature: GZ8MTXP01B0RGY.38.22.B11.1.454.CMB.2.raw
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaagcgcccaccctctcctgcgagggccagtcagtagtgtagcagcaacttagcctaggtaccagacaacgaacctggacccaggcctccccgaggtccctcctcattctagtggtgccaactccccaaccggacggggccctacgttcggtacctccccgagccgaggggtcaggtcgggcagggtcggggtcgtaaggggaactaagggtacttccacgttccctaccaacctactacgacgcgacggtcccgttggacctaagggttaccttaagggtaaagtttacgttttggtactttaaggttttttaactttccgttaggggttactaacgtacctaaagttttaaacctaactttaccgtcggttacccctttacggtaccggttacgggtaccggtttcccgggaaccgggtaaacgggggttaaccgtaaaggggttaaagtaaacgtaacggaaaccggttacgttgggtcggactaacggactaccttcttccgttcgttc

SEQ ID NO: 397551 - DNA, 584 bp, Homo sapiens
  misc_feature: GZ8MTXP01EDMK4.38.22.B11.1.454.CMB.2.raw
  modified_base (197)..(197): a, c, t, g, unknown or other
  modified_base (295)..(295): a, c, t, g, unknown or other
  modified_base (366)..(366): a, c, t, g, unknown or other
  modified_base (416)..(416): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccagtcagagtgttagcagcaacttgcctggtaccagcagaacctggccaggcctcccaggcctcctcatctatggtncactcccaacaggggccactggtactcccgagccgaggggtcaggtcggctaggtggggtctaggggaacnggagtttccacttctaccaccatccagcagcctgctagtctagtaagttntttgattagtttatttcgtggtactagtactaattaactaacttcgtcgtcccttccgtaggtcggtaccggttccgggaaccgtaacggggaaccgtaaagggttacggaaacgtaaccgaaacggttacgttggtcggacgtcgacctaccttacgttcgttcgtc

SEQ ID NO: 397552 - DNA, 595 bp, Homo sapiens
  misc_feature: GZ8MTXP01BE7WR.38.22.B11.1.454.CMB.2.raw
  modified_base (278)..(278): a, c, t, g, unknown or other
  modified_base (287)..(287): a, c, t, g, unknown or other
  modified_base (325)..(325): a, c, t, g, unknown or other
  modified_base (346)..(346): a, c, t, g, unknown or other
  modified_base (367)..(367): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctgcagctccagctccnatctatgtncatccacaggccactggtactcccagccgagggtcagnggcaggtcgggtcaggggacnggagttcacgtctccgaaccntacagcacgccgtgccagtcgtagagtatttgcttatttagtttctggtactagcctaattactaaatttacgtggtaccccttcgtaaccggttcgggtaaccggtttcccgggaacccggtaagggggttaacccgtaaagggttacgggtaaaactaccgaaaaaccgttacggttaggtaaggggtaccctggcctaaccccgttaattccgtttcgttaaccc

SEQ ID NO: 397553 - DNA, 569 bp, Homo sapiens
  misc_feature: GZ8MTXP01BJY3N.38.22.B11.1.454.CMB.2.raw
  modified_base (198)..(198): a, c, t, g, unknown or other
  modified_base (259)..(259): a, c, t, g, unknown or other
  modified_base (273)..(273): a, c, t, g, unknown or other
  modified_base (284)..(284): a, c, t, g, unknown or other
  modified_base (411)..(411): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccacctgtctgtgtctccgaaggggaaangcccaccctctcctgcagggccagtcagagtgtagcagcaattgcctggtacagcagaacngcagctccagctcncatctatggtncatccaaccgagggccacgtggtactcccgagccgaggggtcaggtggacgaggtggggtctaggggacaaggtacgtcacctctcaaccgatcagcacgctgcgagtacgtagtaagtagtttgtntagtttatttcttggttctagtactaattaacttaattacttacggtacctaccgtacgttcggtacggtccggtaacggaacgggaacggaacggttaaggtaaagtaacgaaacgttaacgttagtaacggtacgtcgacgacactcgttcgttcg

SEQ ID NO: 397554 - DNA, 649 bp, Homo sapiens
  misc_feature: GZ8MTXP01AZB6K.38.22.B11.1.454.CMB.2.raw
  modified_base (197)..(197): a, c, t, g, unknown or other
  modified_base (417)..(417): a, c, t, g, unknown or other
  modified_base (426)..(426): a, c, t, g, unknown or other
  modified_base (492)..(492): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcgagggccagtcagagtgttagcagcaacttagcctggtaccagcaagaacctggccaggcctcccgaggtcctcctcatctagtggtcgcactacccacgacgggccacgtcggtacctcccgacgccgtagggtcgaggtggaaggttggggtcgtaggggaacaggtcgttaccacgttccaccaccatcgacgcacgtccngcgtacgtntaggtaattgttttcgactttagtttacttctggttactacgtacttattaacctaacgtttaccncgggttaccctaccgttcggttaccgggtacccggttcgggacccgggtaacgggtaaaccggttacggggttaacgttaaacgtaaccgtaaaggttaccgttggttacgggaacccttggaacccacgtagttccctttaagttccctttaaccg

SEQ ID NO: 397555 - DNA, 673 bp, Homo sapiens
  misc_feature: GZ8MTXP01DN4ER.38.22.B11.1.454.CMB.2.raw
  modified_base (198)..(198): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccacctgtctgtgtctaccgaggggaaancgcccaccctctcctgcagggccagtcagtagtgttagcagacaacttgccttaggacagcgaacgaaaccgtggccaggcctacccgagtcctcctactatctagtgggtcactactacccgaacgacgggtcctacgttaggtaacctccccgacgccgtaggggtcctaaggtcgggacgtagggttcggggtaccgtaacgggggaactaaggggtaacctttcccgaaacctttcccaccaacccgtataccgaacgtcacggtccctggacctagtacgtagtaaagttgtttcgacttagttttactttcgttaggtacctagtactaatttaactaacttacgtcgttaccgtccgttacgttcggtaccggttcgggtaacgaacgggttaacggtaagggttaagtaaacgtacgaaaacgttcgttacggtggtactcggactacttacgttcgttcgttaacc

SEQ ID NO: 397556 - DNA, 698 bp, Homo sapiens
  misc_feature: GZ8MTXP01ACLA5.38.22.B11.1.454.CMB.2.raw
  modified_base (200)..(200): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaanacgcccaccctctcctgcgagggccagtcagagtgttagcagctaacttgcctggtaccagcaagaacctggccaggcctccaggcctcctacatctagtggtcacctactcccgaccgacgggcctacgtcgggtaacctccccgaaggtcccggtaagggtccgaacggttcgggacgtaggggttcggggtacgtaacggggaacaacggttacgtaccaccgtcctaccaacctataccgacgtaccgacggtccgtagccgtaaggttcgtaagtaaaggtttacttttcggactttaaggtttttactttccgaggggtttacaacggttaccttaaacgtttaaacgtaacctttacggcccggtttacccgtaccgttaacggggtcggtaccgttaccggggcgaaacggggttaccgtaaaggacgtaaaacgtaacgaaaggttacgttggtaacggtctcgacctcgttacgttcttcgttaaccc

SEQ ID NO: 397557 - DNA, 679 bp, Homo sapiens
  misc_feature: GZ8MTXP01C3WRL.38.22.B11.1.454.CMB.2.raw
  modified_base (199)..(199): a, c, t, g, unknown or other
  modified_base (301)..(301): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcagcaacttagcctagggtaccagcaagaaacctggccaggcctccgagctcctcatctagtggtcncactcccaacgacgggcccaacgttggtactccccgaggacccgtaggggtaccaagggttcggacgagggttcgggggtcgtagggggaacctggtacgtttcaaccgttcctaccacctatcgaacgtcacgtcccgtgaccgaagttcgttaggtaaagttaacttttcggacttaggtttttactttaccgttgggttaactagtaccttaagtttaacctaaatttacgttccggtacccttcgttaccggtacggggtaacccggtttcgggaacccggtaacgggggttaaacccgtaaagggttaacggtaaaactacgaaaaacgggttcttagggtcgtacgtgacctaaccttatccgttcgttaac

SEQ ID NO: 397558 - DNA, 650 bp, Homo sapiens
  misc_feature: GZ8MTXP01BO2IB.38.22.B11.1.454.CMB.2.raw
  modified_base (200)..(200): a, c, t, g, unknown or other
tcagtcgatcacgtcacgaccggtgctcgatttagacgacagctcaggggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaagngcccaccctctcctgcagggccagtcagagtgttagcagcaacttagcctggaccagcagaacctggccaggcctcccgagctcatcatgtatggttcactcccaccgagggccacgtggtcgtcccgaggctagggttcaggagggaggcggggtcgtgggggaaacagggtcgttaccaccgttcctacccaaccgtaatttaaaccgacgttccgtgccgtaagggctaaggtaagttagttttgacgtttagttttaccttcgttgtacagtactaattagtacgtacttaccggtcggtcccgtacggggtaccggttcggaccgagggtacggggaccggtaagggtagggaaacgtaaccgaaacggtaacgtgggttcgggttccttcggaacccaccgttaagtccgtttcgttaccgtttccttaacccgttttcccccg

SEQ ID NO: 397559 - DNA, 581 bp, Homo sapiens
  misc_feature: GZ8MTXP02J12RY.38.22.B11.1.454.CMB.2.raw
  modified_base (196)..(196): a, c, t, g, unknown or other
  modified_base (312)..(312): a, c, t, g, unknown or other
  modified_base (353)..(353): a, c, t, g, unknown or other
  modified_base (399)..(399): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttgctgtacagcagaacctggccagctcccacggctcctcatctatggtgcactccaccagggccactggtacncccagccaggggtacagtggcgacggtgggtcgtggggacngagttcgctctccaccatcaagcagccctgcagtctagaaagtttntttgcttagttttacttcgtgtacagtactaactttaaactaacttcgtccggtacccttacgttaacgggtcggtaacccggttccggaccgggaacgggaaccgtaaaggggtaacgaaaactaccgaaaacggtacgtggtaacggtccgtacgaccgtaacctcgttacgttcgttac

SEQ ID NO: 397560 - DNA, 529 bp, Homo sapiens
  misc_feature: GZ8MTXP02HUGCW.38.22.B11.1.454.CMB.2.raw
  modified_base (283)..(283): a, c, t, g, unknown or other
  modified_base (293)..(293): a, c, t, g, unknown or other
  modified_base (356)..(356): a, c, t, g, unknown or other
  modified_base (397)..(397): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaacctggccaggctcccaggctcctnatctatggtncatccaccagggcccagtggtatccccagccgagggtcaggtggcaggtggggtctggggacnggacgttcactctcaccatcagcagcctgcagtctgaagtntttgctagtttattctgtcagctattacattactgtcctctacgtggtacgttcggccgaggggtaccaaggtacggaaactacgaaaacgtaacgtggtaacggctacgaccaaccgtactcgttagttcc

SEQ ID NO: 397561 - DNA, 554 bp, Homo sapiens
  misc_feature: GZ8MTXP02FZKRC.38.22.B11.1.454.CMB.2.raw
  modified_base (197)..(197): a, c, t, g, unknown or other
  modified_base (296)..(296): a, c, t, g, unknown or other
  modified_base (359)..(359): a, c, t, g, unknown or other
  modified_base (397)..(397): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcaagaaacctggccaggctcccaggcctcctcatctatggtncatcccaccgagggccacgtggtactcccagccagggtcaggtggcaggtgggtctggggacnggtacgttcactcctacaccatcagcagcctgcagtcngaagtatttgactagtttattctgtcagtctattacaattacgtcggtccttacgtacggtagggtaccggttccggaccggtacgggggtaaccgaaagggttaggaaaactacgaaaacgacgtagtaaggcgtacgaccaacctatctacgttc

SEQ ID NO: 397562 - DNA, 498 bp, Homo sapiens
  misc_feature: GZ8MTXP02IWCCY.38.22.B11.1.454.CMB.2.raw
  modified_base (194)..(194): a, c, t, g, unknown or other
  modified_base (291)..(291): a, c, t, g, unknown or other
  modified_base (353)..(353): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccaggggaangccacctctcctgcagggccagtcagagtgttagcagcaacttagcctggtaccagcagaaacctggccaggctcccaggcctcctcatctatggtncatcccacagggccactggtactccccagccaggggtcaggtggcaggtgggtctggggacnggagttcactctcaccatcagcagcctgcagtctgaagtatttgctagtttatttctgtcagctattacaattctgtcctctacgtgacgttcgcgagggaccaggtagaaactcgaaaacgactgtggctgacacatctcgttc

SEQ ID NO: 397563 - DNA, 509 bp, Homo sapiens
  misc_feature: GZ8MTXP02JXEA5.38.22.B11.1.454.CMB.2.raw
  modified_base (352)..(352): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggcccactggtatcccagccagggtcagtggcagtgggtctggggacngagttcactctcaccatcagcagcctgcagtctgaagtattttgctagtttattctgtcagctattacaattactggtccctctacgtggacgttcggccgaggggaccaagggtaggaaactacgaaacgaactgtaaggctcgcaccatactgtc

SEQ ID NO: 397564 - DNA, 665 bp, Homo sapiens
  misc_feature: GZ8MTXP02H1F46.38.22.B11.1.454.CMB.2.raw
  modified_base (196)..(196): a, c, t, g, unknown or other
  modified_base (295)..(295): a, c, t, g, unknown or other
  modified_base (319)..(319): a, c, t, g, unknown or other
  modified_base (362)..(362): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggcctcctcatctatggtncatccaccagggccactggtaccncccagccgaggtcaggtcggacgtaggtgggtcggtcggacgngtacgttactacctcctacctacctactaccacgacgacgtccgtcgcgtacgttacgttagtaagttagtttcgttacgttagttttattttcgtttcgttcgtagtacttaacttaacttaactttaccgttaccgttacccgttaccgttaccggttacgggtaccggttaccgggtacccgggtaaccggggtaaaccgggtaaacgggtaaacgggtaaacgtaaaccgtaaaaccggtaaacgtacggtaacggtaccgtacgtaccgtaaccgtaccgttacgtttacgtttaccg

SEQ ID NO: 397565 - DNA, 596 bp, Homo sapiens
  misc_feature: GZ8MTXP02G9KH4.38.22.B11.1.454.CMB.2.raw
  modified_base (198)..(198): a, c, t, g, unknown or other
  modified_base (284)..(284): a, c, t, g, unknown or other
  modified_base (294)..(294): a, c, t, g, unknown or other
  modified_base (319)..(319): a, c, t, g, unknown or other
  modified_base (348)..(348): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactgaagaaatagtgatgacgcagtctccagccaccctgtctgtgtctccgaggggaaagngccaccctctcctgcagggccagtcagagtgttagcagcaacttagcctggtaccagcagaacctggccaggctcccaggcctccnatctatggtncactcccacgagggccagtggtacncccagccagggtcaggtgcaggtgggtcnggggacaggtcttcactcctacaccatcagcacgcctgcagtctagaagtatttgacttagtttattcgtgtctagtctaatttaacaattaccgtcggtacccttaccgtacggttgggtaccgtttccgggaccggtaacgggggtaaacccgtaaaggggtaacggaaaacgttaaccgaaaacggtaacgttacgggtaacggtaccgtacggaccctaaccggtactccgtttacggtttacc

SEQ ID NO: 397566 - DNA, 528 bp, Homo sapiens
  misc_feature: GZ8MTXP02JW7NB.38.22.B11.1.454.CMB.2.raw
  modified_base (197)..(197): a, c, t, g, unknown or other
  modified_base (284)..(284): a, c, t, g, unknown or other
  modified_base (294)..(294): a, c, t, g, unknown or other
  modified_base (318)..(318): a, c, t, g, unknown or other
  modified_base (346)..(346): a, c, t, g, unknown or other
  modified_base (353)..(353): a, c, t, g, unknown or other
  modified_base (365)..(365): a, c, t, g, unknown or other
  modified_base (506)..(506): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccaggggaaangccaccctctcctgcagggccagtcagagtgttagcagcaacttagcctggtaccagcagaaacctggccaggctcccaggctcctnatctatggtncatcccaccagggcccatggtacncccagccaggggtcagtgcaggtggtcnggggacngagttcacgtcncaccatcagcagacgtgggaggctagaagtagttttgcgtagttgttaattactggtacagacagtaataactaacaacgtaccgtactacgtttcggaccgaacggggaccaagcgtaggaacgaaccaaaacgactagngcgtcgacaccatctctacttc

SEQ ID NO: 397567 - DNA, 540 bp, Homo sapiens
  misc_feature: GZ8MTXP02JL013.38.22.B11.1.454.CMB.2.raw
  modified_base (195)..(195): a, c, t, g, unknown or other
  modified_base (203)..(203): a, c, t, g, unknown or other
  modified_base (280)..(280): a, c, t, g, unknown or other
  modified_base (290)..(290): a, c, t, g, unknown or other
  modified_base (300)..(300): a, c, t, g, unknown or other
  modified_base (345)..(345): a, c, t, g, unknown or other
  modified_base (352)..(352): a, c, t, g, unknown or other
  modified_base (363)..(363): a, c, t, g, unknown or other
  modified_base (368)..(368): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccacctntcctgcagggccagtcagagtgttagcagcaacttagcctggtaccagcagaacctggccaggctcccaggctcctnatctatggtncatcccacgngggcccagtggtactcccgagccaggggtcaggtgcagtgggtcnggggacngagttcactcncaccntcagcagcctgcagtcagagtatttgctagtttattctgtcagtctattactaattacgtcggtccttcctacggtggtacgttcgggaccgtacgggggaccgtaagggtacggtaaaactacgtaaaacgtaacgtggtaaggcgtacgccgacctacgtcgtcgttacc

SEQ ID NO: 397568 - DNA, 569 bp, Homo sapiens
  misc_feature: GZ8MTXP02GKB8V.38.22.B11.1.454.CMB.2.raw
  modified_base (197)..(197): a, c, t, g, unknown or other
  modified_base (295)..(295): a, c, t, g, unknown or other
  modified_base (361)..(361): a, c, t, g, unknown or other
  modified_base (402)..(402): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccttgtctgtgtctccgaggggaaanagccaccctctcctgcagggccagtcagagtgttagcagcaacttagcctggtaccagcagaacctggccaggctcccaggctcctcatctatgggtncatcccaccgaggggcccacgtggtactccccagccaggggtcagtggcaggtgggtctggggacnggagttcactcctcaccatcagcagcctgcagtctgaagtnttttgacttagtttatttctgtctagtctaatttaacaattacgtacggtccttacgtacggtggtaccgttcgggaccggaacggggtaccgtaaacggggttaggaaaacgtaccgaaaaacgtacgtaggtaagggtcctaggaccaccgtatccgtgtttacc

SEQ ID NO: 397569 - DNA, 546 bp, Homo sapiens
  misc_feature: GZ8MTXP02FVHG6.38.22.B11.1.454.CMB.2.raw
  modified_base (197)..(197): a, c, t, g, unknown or other
  modified_base (296)..(296): a, c, t, g, unknown or other
  modified_base (354)..(354): a, c, t, g, unknown or other
  modified_base (371)..(371): a, c, t, g, unknown or other
  modified_base (387)..(387): a, c, t, g, unknown or other
  modified_base (393)..(393): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccagtcagagtgttagcagcaacttagcctggaccagcagaacctggccaggctcccgaggcctcctcatctatggtncatccacagggccacgtggtactcccagccagggtcaggtgcaggtggtctggggacnggagttcactctcacancagcagcctgcagtcngaagtntttgacttagtttatttctgtcagtctaattactaaattcgtcggtcccttccgtaggttggtaccggttccggaccgtaagggggtacctaaaggggtaggaaaactacgaaaacgtacgtaggtcggcgtacgacctaacctctcgtcgtc

SEQ ID NO: 397570 - DNA, 507 bp, Homo sapiens
  misc_feature: GZ8MTXP02I02W3.38.22.B11.1.454.CMB.2.raw
  modified_base (196)..(196): a, c, t, g, unknown or other
  modified_base (288)..(288): a, c, t, g, unknown or other
  modified_base (292)..(292): a, c, t, g, unknown or other
  modified_base (346)..(346): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaacctggccaggctcccaggctctcatctanggtncatcccacagggccatggtactcccagccagggtcagtgcagtggtctgggacngagttcactctcaccatcagcagcctgcagtctagaagtatttgctagtttattatttgtctagtctagtatgatctagtgcctcgatccaccttcggccgacgggggacacgtacgtacggaactaaagtaaacgaactggtacggctacgccacctacg

SEQ ID NO: 397571 - DNA, 603 bp, Homo sapiens
  misc_feature: GZ8MTXP02GPOFM.38.22.B11.1.454.CMB.2.raw
  modified_base (297)..(297): a, c, t, g, unknown or other
  modified_base (364)..(364): a, c, t, g, unknown or other
  modified_base (383)..(383): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggcctcccaggcctcctcatctagtggtncatcccacgagggccacgtggtactcccgagccgaggggtcaggtggctaggtgggtcgtggggacnggtagttcactctacaccntcagcacgcctgctagtctagaagttattttgacttagttttatttcgtgttcagtactattaactaactttccgtacggtcccttaccgttcggttacgggtacggttccggaccggtacgggggaccctaaaggggttacggaaaacgttacccgaaaacggtaacgttcgggtaacggtactacggaccctaaccgtactttccgttacgtttaccc

SEQ ID NO: 397572 - DNA, 736 bp, Homo sapiens
  misc_feature: GZ8MTXP02G6035.38.22.B11.1.454.CMB.2.raw
  modified_base (294)..(294): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaagagccaccctctcctgcagggccagtcagagtgttagcagcaacttgcctggtaccagcagaacctggccaggcctcccaggcctcctcatctatggtncactcccaccgagggcccacgtggtactccccgagcccgaggggtcaggtggcgtaggtcggggtctaggggacagggtacgtttaccaaccttccgtaccaaccctagttcccgaaacggtcccgtaacggccccttacgggacccttaacgggttaccgttacgggtaaaacggtttaattttttcgggacctttaaaggttttttaacttttccgtttaggttacctaaggtaccttaaacgtttaaacctaaacgttttaaccgttccgggttacccctttacccgttaaccgggttacgggtaaccggtttccggggtaaccggtaacggggggtaaacccgtaaagggggttaaacggaaaacgttaaccggaaaacgtaaccgtagggttaacggacgttacggaccctaaccgtacgttaccgttcgtttaccc

SEQ ID NO: 397573 - DNA, 588 bp, Homo sapiens
  misc_feature: GZ8MTXP02I2DR2.38.22.B11.1.454.CMB.2.raw
  modified_base (296)..(296): a, c, t, g, unknown or other
  modified_base (366)..(366): a, c, t, g, unknown or other
  modified_base (411)..(411): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgcagggccagtcagagtgttagcagcaacttagcctggtaccagcagaacctggccaggcctcccaggcctcctcatctatggtncatcccaccgagggcccacgtggtactccccagcccgaggggtcaggtggctaggtggggtctggggacnggtagttcactcctaccacatcagcagcctgcagtctagtaagtntttgacttagttttacttcttgttcagtctatttaactaacttacgtcggtccttaccgtacggtcggtaccgttccggaccggacggggtaacccgtaagggtaggaaaacgttaccgaaaacggtacgttagggtaacggtaccgtaggaccctacctacgttcgttacgtttcc

SEQ ID NO: 397574 - DNA, 532 bp, Homo sapiens
  misc_feature: GZ8MTXP02JECEB.38.22.B11.1.454.CMB.2.raw
  modified_base (197)..(197): a, c, t, g, unknown or other
  modified_base (355)..(355): a, c, t, g, unknown or other
  modified_base (372)..(372): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcagaaacctggccaggctcccgaggcctcctcatctatggtgcatccacgagggccacgtggtactcccagccagggtcagtggcaggtgggtctgggacngtcgttcactctcaccntcagcagcctgctagtcagtaagttagttttgacttagttttattagttgtactagtctagttatgatcgaggtcgcctacgatccgtaccgttcggaccgtacggggacacggacgtacggaacaaagtaacgaactcggtacggctacgaccacgtac

SEQ ID NO: 397575 - DNA, 551 bp, Homo sapiens
  misc_feature: GZ8MTXP02G3YS8.38.22.B11.1.454.CMB.2.raw
  modified_base (282)..(282): a, c, t, g, unknown or other
  modified_base (290)..(290): a, c, t, g, unknown or other
  modified_base (440)..(440): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcaacttagcctggtaccagcagaacctggccaggctcccagctccnatcatgtncatccaccagggccacgtggtactccccgagccgagggtcaggtggcaggtggggtctggggacaggtagttcactctcaaccatcagcagcctgcagtctagaatatttgacttagtttatttctgtctagtctaattactaattacgnggtccttcgtacggtcggtacgttcggaccgtacggggacctaaagggtacggtaaacaccgtaaaacgacgtaggtaacgtcgtacggacctaccgtatccgtgtttacc

SEQ ID NO: 397576 - DNA, 734 bp, Homo sapiens
  misc_feature: GZ8MTXP02JR81P.38.22.B11.1.454.CMB.2.raw
  modified_base (196)..(196): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttgcctggtaccagcagaacctggccaggcctcccaggcctcctcatctagtggtcgctactcccaccgacgggcccaacgtcggtactccccgagcccgagggtcacggtggcgtaggtcgggtctggggacagggtcgttcaccgttctaccgaacctagtaccgaagtccgaacgtcccgtacggaccgtacggttccgttaagggtaaacgtttacgtttttacggaaccgtttaggttttttaactttccgttaggttaccgtaacgttaccttaaacgtttaacctaaacgtttacccgttaccggggttacccctttacccgttaccggggttaccgggtaacccggtttacccggggaacccggggtaaaccgggggtaaacccggtaaagggggttaaccggtaaaaccgttaccgtaaaaaccggtacggtaccgggtaacggtaccgtacggacccgtaacccttagttaccgttacggtttccc

SEQ ID NO: 397577 - DNA, 632 bp, Homo sapiens
  misc_feature: GZ8MTXP02IAHHT.38.22.B11.1.454.CMB.2.raw
  modified_base (196)..(196): a, c, t, g, unknown or other
  modified_base (436)..(436): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccacctctcctgcagggccagtcagagtgtagcagcaacttagcctggtacccagcaagaaaccctgggaccagggcctcccgaggcctcctcatctatggtgcactcccaccgaggggcccacgtcggtactccccgagcccgaggggtccaggtggcagggttggggtctaggggactaggtacgtttacaccttcaccgacctatcacgcacgccctgccagttctagaaagttntttgacttagttttatttcttgtactagtcttaattactaactttacgtcggtacccttacggttacggttcgggtaccggtttaccgggaccggtaacgggggtaaacccaaagggggttaacggaaaaacgttaccgaaaacggttaaccgtgggtcggaccgtaggaccctaaaccgtcttacgttacgttcc

SEQ ID NO: 397578 - DNA, 552 bp, Homo sapiens
  misc_feature: GZ8MTXP02HC943.38.22.B11.1.454.CMB.2.raw
  modified_base (197)..(197): a, c, t, g, unknown or other
  modified_base (294)..(294): a, c, t, g, unknown or other
  modified_base (359)..(359): a, c, t, g, unknown or other
  modified_base (384)..(384): a, c, t, g, unknown or other
  modified_base (402)..(402): a, c, t, g, unknown or other
  modified_base (542)..(542): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttgcctggtaccagcagaacctggccaggcctccaggcctcctcatctatggtncatcccacgacgggccacgtggtactcccgagccgagggtcaggtggcaggtgggtctggggacnggtacgtttcaccgttctccaacgntaccagcacgtcctgacngtcgtagacgttagttttgacttaagttttattagtttagactagtactaggttatagatcgtagtcgtcctacgatccgtaccgttcggacggacgggacacggacgtacggaacaaagtaacgacgtcggtacgtacncgaccactag

SEQ ID NO: 397579 - DNA, 578 bp, Homo sapiens
  misc_feature: GZ8MTXP02HDVDI.38.22.B11.1.454.CMB.2.raw
  modified_base (197)..(197): a, c, t, g, unknown or other
  modified_base (286)..(286): a, c, t, g, unknown or other
  modified_base (296)..(296): a, c, t, g, unknown or other
  modified_base (317)..(317): a, c, t, g, unknown or other
  modified_base (351)..(351): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttgcctggtaccagcaagaaacctggccaggcctcccaggcctcctnatctatggtncatccacagggccatggtacncccagccagggtcagtgcaggtgggtctgggacnggtagttcactctcaccatcagcagcctgcagtctagaagttattttgactagttttatttcgtgtctagtactattaactaatttacgtcggtcccttacgttacggtcgggtacgtttcgggaccgtacgggggaaccaaagggtacggaaaacgttaccgaaaacggtaacgttacgggtaacggtacgtacggaccaaccgtacgttccgttaacggtttccc

SEQ ID NO: 397580 - DNA, 599 bp, Homo sapiens
  misc_feature: GZ8MTXP02ISQJY.38.22.B11.1.454.CMB.2.raw
  modified_base (198)..(198): a, c, t, g, unknown or other
  modified_base (294)..(294): a, c, t, g, unknown or other
  modified_base (298)..(298): a, c, t, g, unknown or other
  modified_base (323)..(323): a, c, t, g, unknown or other
  modified_base (348)..(348): a, c, t, g, unknown or other
  modified_base (364)..(364): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttagcagcaacttagcctggtaccagcaagaaacctggccaggcctcccaggcctcctcatctanggtncatcccacgagggccacgtggtacnccccgagccgagggtcaggtcggcngtggggtctggggacngggtagttcacgtctccacatcagcagcctgcagtctagaagttattttgacttagttttatttcgttgtactagtaccttattaacctaatttaccgtcggtcccttaccgttacggttacgggtaccggtttccgggaccgggacgggggtaaccgaaggggttaaacgaaacgtaccggaaaacgtacgttaggtaacggcgttacgaccctacgactttccgtacgtttcc

SEQ ID NO: 397581 - DNA, 669 bp, Homo sapiens
  misc_feature: GZ8MTXP02JEKKI.38.22.B11.1.454.CMB.2.raw
  modified_base (196)..(196): a, c, t, g, unknown or other
  modified_base (294)..(294): a, c, t, g, unknown or other
  modified_base (366)..(366): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccaccctctcctgcagggccagtcagagtgttagcagcaattagcctgaccagcaagaacctggccaggcctcccgaggcctcctcatctatggtncatcccacgcggccagtggtactcccgagcccgtagggtcacggtcggctaggttcggggtcgtaggggacnggtacgttcaacgttccgtaccacctaatccgaacgccgaacggtccctaggccctaaggttcgtacggtaagtttagtttttgaaccgtttagttttttacgttccgttggttaccgtaagttaccttaaatttaaaccgtaaacgtttaccggttccggtacccctttaccggttacgggttacggggttacccgttaccggggtaccggaaacgggggtaccgtaaaacggggtaggtaaaaccttaacgaaaacggtcctaggtaacggctacgcctaacctggttcctcgtttacccg

SEQ ID NO: 397582 - DNA, 620 bp, Homo sapiens
  misc_feature: GZ8MTXP02FZXX0.38.22.B11.1.454.CMB.2.raw
  modified_base (197)..(197): a, c, t, g, unknown or other
  modified_base (298)..(298): a, c, t, g, unknown or other
  modified_base (308)..(308): a, c, t, g, unknown or other
  modified_base (363)..(363): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaactagcctggaccagcaacgaaacctggccaggcctcccgaggcctcctcatctagtggcncactccacgngggccacgtggtactcccagccgaggtcacggtcgcgaggtcgggtctggggacnggtacgttccacgttcctacgacctagtcagcgaggacgtgggacggtcgtaggaacgttagtttggacgtaggttacgttaatttaccgtgtacgtagtacgtaagttaaactaaccgtaacgtaacggtaacccgttaacgttaccgtttacgggacccggtaaggggaacccgtaggacgtaacggaaacgaaaccgtaacgtaacgtcggtacgaacgtacgacctaacctcgttactacgttacctttaccg

SEQ ID NO: 397583 - DNA, 539 bp, Homo sapiens
  misc_feature: GZ8MTXP02JP60X.38.22.B11.1.454.CMB.2.raw
  modified_base (196)..(196): a, c, t, g, unknown or other
  modified_base (282)..(282): a, c, t, g, unknown or other
  modified_base (292)..(292): a, c, t, g, unknown or other
  modified_base (358)..(358): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttagcagcaacttgcctggtaccagcagaacctggccaggctcccaggcctcctnatctatggtncatcccaccgagggccagtggtactccccgagccaggggtcaggtggcaggtggggtctggggacnggtacgttcacgttctacaccatcagcacgcctgcagtctgaagtatttgacttagttttattatttgtactagactagtatgtatcgtaggtcgcctcgatccgtaccgttcggaccgacggggacctacggtacgtacggaactaaagtaaaccgacgtcggtcgactacgacactacg

SEQ ID NO: 397584 - DNA, 669 bp, Homo sapiens
  misc_feature: GZ8MTXP02ISJBP.38.22.B11.1.454.CMB.2.raw
  modified_base (199)..(199): a, c, t, g, unknown or other
  modified_base (302)..(302): a, c, t, g, unknown or other
  modified_base (317)..(317): a, c, t, g, unknown or other
  modified_base (410)..(410): a, c, t, g, unknown or other
  modified_base (415)..(415): a, c, t, g, unknown or other
  modified_base (420)..(420): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaancgcccaccctctcctgcagggccagtcagagtgtagcagactaacttgcctaggtacccagcaagtaaaccgtggccagggccctacccgaggtcctccctanacttcgtatgggtcncactacccacgagggccctacgtggtactcccgagccgagggtcaggtcgctaggtgggtctggggactggtcgttcacttccacaccatcancgacnccgtncgtagttactaggtaacgttagttttcgactttaagtttttatttcgttagtactagtaaccttaatttaaccgtaagtttaccgtaccggttaccctttaccggttacggttaccgggttaccgggtttcccgggaaccggtacgggggtaaaaccgtaaagggttaaacgggaaaactaacccgaaaacgtacggttcggtaacggtaccgtacgaccgtaccgtaactttccggtttaacgttccc

SEQ ID NO: 397585 - DNA, 661 bp, Homo sapiens
  misc_feature: GZ8MTXP02GDG0X.38.22.B11.1.454.CMB.2.raw
  modified_base (195)..(195): a, c, t, g, unknown or other
  modified_base (294)..(294): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaangccacctctcctgcagggccagtcagagtgttagcagacaacttgcctggaccagcaagaacctggccaggcctccgagtcctcctcatctatgggtcncactccaccgagggacctacgtggtactcccgagccgagggtcaggtcggcgtagggtcggggtcgtacggggactagggtacgttaccaaccttccacctaaccgtctacacgggtcaccggccctgggactaacggttactaaggtaagttatttttcgaacgtttaggttttactttctacgttacgtaagttacccttaatttaaaccgtaactttacgccgggttaccctttaccgtacgggttacggggtacccggttacggggaccgggtaacgggggtaaacctaaagggggtttaaaacgaaacgtaacgaaaacggtacgtggttaacggactacgaccaacctctacgtttcttac

SEQ ID NO: 397586 - DNA, 538 bp, Homo sapiens
  misc_feature: GZ8MTXP02IQ2OJ.38.22.B11.1.454.CMB.2.raw
  modified_base (196)..(196): a, c, t, g, unknown or other
  modified_base (204)..(204): a, c, t, g, unknown or other
  modified_base (287)..(287): a, c, t, g, unknown or other
  modified_base (312)..(312): a, c, t, g, unknown or other
  modified_base (349)..(349): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccacctntcctgcagggccagtcagagtgtagcagcaacttgcctggtaccagcagaactggccaggctccgaggctctcatctatggtncactccacgagggccacgtggtacncccgagccgagggtcagtggcaggtgggtctgggacnggtacttcgactctcacgatcagcagctgctagtctagtaagttactttgactagttttacttcctggttacagtactaatacgtgtactaccgtcggtccgtacggtacgttcgactcggtacgggacggagggtaacgacgtacgaaaacgtcgtaggtcgactcggactacgacttcgtacgttac

SEQ ID NO: 397587 - DNA, 731 bp, Homo sapiens
  misc_feature: GZ8MTXP02FPHIF.38.22.B11.1.454.CMB.2.raw
  modified_base (197)..(197): a, c, t, g, unknown or other
  modified_base (286)..(286): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcagcaacttagcctggtaccagcaagaacctggaccagactcccaggcctcctnatctagtggtgcactccaccgacgggcccacgtggtactccccaggcccaagggtcaggtcggacaggggtcggggtctaggggaactaggtacttccaacgttcccgtaccaaccctaagtcccaacgacgtacgtcccgtacggacgtaaggttaccgtaggttaaaaggttactttttcgggactttaaggttttttaactttccggtacggtttaccaaaggttaccctttaaaacgtttaaaccttaaaacgtttaccggttccggtaccccgtttacccggttaccgggttagggggttaaccccggtttacccgggaccgggtaaaacgggggtaaaccctaaacgggggttaaggtaaaacgttaaacccgaaaacggttaaccgttagggaaccggtaaccgtacggaccctaacctacgttcctacggtttcccc

SEQ ID NO: 397588 - DNA, 578 bp, Homo sapiens
  misc_feature: GZ8MTXP02FML7J.38.22.B11.1.454.CMB.2.raw
  modified_base (144)..(144): a, c, t, g, unknown or other
  modified_base (197)..(197): a, c, t, g, unknown or other
  modified_base (283)..(283): a, c, t, g, unknown or other
  modified_base (293)..(293): a, c, t, g, unknown or other
  modified_base (315)..(315): a, c, t, g, unknown or other
  modified_base (344)..(344): a, c, t, g, unknown or other
  modified_base (350)..(350): a, c, t, g, unknown or other
  modified_base (352)..(352): a, c, t, g, unknown or other
tcagtcgatcacgtcacgaccggtgctcgatttagacgacagctcagggggaggaactgctcagttaggacccagacggaaccatggaagccccagcgcagcttctcttcctcctgctactctggctcccagataccactgganaaatagtgatgacgcagtctccagccaccctgtctgtgtctccgaggggaaangccaccctctcctgcagggccagtcagagtgttagcagcaacttagcctggtaccagcagaacctggccaggcctccgagctcctnatctatggtncatccacgaggccactggtacnccgagccgaggtcagtgcaggtcgggtcngggacngnttcacttcacacatcagcacgcctgacagtctagtaattagttttgactagttttatttcgagttacagtacctaatttaaacctagtttaccgtcggtaccctaccggtaacggttcggggtaccgttcggacggtaaacggggtaccaaacgggttagaaaactaacgaaaaccggtattggggtaaccgacgttacggctaacctcgttacttccgtttaacc

SEQ ID NO: 397589 - DNA, 521 bp, Homo sapiens
  misc_feature: GZ8MTXP01B498X.39.85.H08.1.454.CMB.2.raw
  modified_base (487)..(487): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccagggaaggggctggagtgggtctcagttattagtggtagtggtagtagcacagattacgcagactccgtgaagggccggtcaaccatctccagagacaattccaacagcacgctgtattgtcacatgaacagcctgagagccggaggacacggccatatattattgtgtcgaaacttcctttgtctggttattattcccctagtgcgcncggggtcaggaaccctggtcaccgtcttccgtcc

SEQ ID NO: 397590 - DNA, 532 bp, Homo sapiens
  misc_feature: GZ8MTXP01D8877.39.85.H08.1.454.CMB.2.raw
  modified_base (452)..(452): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgagggaaggggctggagtgggtctcagttattagtggtagtggtagtagcacagattacgcagacctccggtgaacgggccggttcaaccatctccagagacaattccaacagcacgctgtatttgcacatagaacagcctgagagccggaggacacggccatatattattgtntcgtaaacttcctttgaacttggttattacttccctagtcgcgacgttcggggccagggaaccctggcaccgtcttctcg

SEQ ID NO: 397591 - DNA, 532 bp, Homo sapiens
  misc_feature: GZ8MTXP01ANQTA.39.85.H08.1.454.CMB.2.raw
  modified_base (420)..(420): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcacctttgacaagtgtgccatgacctgggtccgccaggctccagggaaggggctggagtgggtctcagttattagtggtagtggtagtagcacagattacgcagacctccgtgaagggccggttcaaccatctccagagacaattccaacagcacgctgtatttgcacatgaacagcctgagngccggaggacacggccatatattattgtgtcgtaaatttcctttgaacttggtttattagttcccctagtgaccgcttgggggccagggaacctgggtcaccgtcttccgtc

SEQ ID NO: 397592 - DNA, 526 bp, Homo sapiens
  misc_feature: GZ8MTXP01ACNQ7.39.85.H08.1.454.CMB.2.raw
  modified_base (270)..(270): a, c, t, g, unknown or other
  modified_base (387)..(387): a, c, t, g, unknown or other
  modified_base (521)..(521): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcacctttgacaagtgtgccatgacctgggtccncagctccagggaagggctggagtgggtctcgagttattagtggtagtggtagtagcacagattacgcagacctccgtgaacgggcccggttcaaccatctccagagacaattccaanagcacgctgtattgcacatgaacagcctgagagccggagacacggccatatattatagtgtacgtaaacttcctttgaactggttatacttccccgtagtcgaccagttcgggcagggaaccctggtcacgtcncctcg

SEQ ID NO: 397593 - DNA, 541 bp, Homo sapiens
  misc_feature: GZ8MTXP01BKF25.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccagggaaggggctggagtgggtctcagttattagtggtagtggtagtagcacagattacgcagacctccgtgaagggccgttcaaccatctccagagacaattccaacagcacgctgtatttgcacatgaacagcctgagagccggaggacacggccatatattattgtgtcgtaaacttcctttgaacttggttattacttccccgtagtcgaccgcgttcgggggccacggggtaaccctgggtccaccggtcttcccgtcg

SEQ ID NO: 397594 - DNA, 593 bp, Homo sapiens
  misc_feature: GZ8MTXP01A0685.39.85.H08.1.454.CMB.2.raw
  modified_base (269)..(269): a, c, t, g, unknown or other
  modified_base (336)..(336): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatcgacctgggtccnccgaggactccgaggggaaggggctgggagtgggtctcgagttattaggtggtagtggtagtagcanagattacgcagacgtccgtaggaagggtcccgttacaccaatctcagacgaacaacttccaaacagtccaacgtcttagtaatttgacaacatagaacagcctgacgagccgagggacacggcatatattatgtagacgtaaacctttctttagacgttgttaacttcctcccgttagtacgacccgttacggttcgggggacccgtaacgggggtacccttcgggtaccacccggttcctcccgttccgtaacccg

SEQ ID NO: 397595 - DNA, 568 bp, Homo sapiens
  misc_feature: GZ8MTXP01BW0SJ.39.85.H08.1.454.CMB.2.raw
  modified_base (398)..(398): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgaccgtggtccgccaggctccgagggaagggctggagtgggtctcgtagtttagttaggtggtagtggtagtagcacgagatacgcagacctccggtagaacgggcccgttcaaccatctccaagacgaacaatccaaacncgacacgctgtattgacacatagaacagctagagagccgggagacacggacagtatattatgtgtaccgttaaactttcctttagaaccttggttaacttacttccccgtagtcgacccgttgttcggggaaccaacgggtaacctcgggccttaccgtccttaacgccg

SEQ ID NO: 397596 - DNA, 573 bp, Homo sapiens
  misc_feature: GZ8MTXP01BD7ZU.39.85.H08.1.454.CMB.2.raw
  modified_base (270)..(270): a, c, t, g, unknown or other
  modified_base (343)..(343): a, c, t, g, unknown or other
  modified_base (396)..(396): a, c, t, g, unknown or other
  modified_base (424)..(424): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtcccnccaggctccgagggaaggggctgggagtgggtctcgagtttattagtggtagtggtagtagcacagattacgnagacctccggtagaacgggccgttcaaccatcctccagagactaattccaaanagcacgctgtatttgacacgatagaacngcctagagagccgggaggacaccggccaatatattagttgtgtacgtaaactttccttttgaacttggtttattacttccccgtagtcgaccgttacggttcggggaaccctaggggaacccctggtcccacccgtcttcccgtaaccg

SEQ ID NO: 397597 - DNA, 531 bp, Homo sapiens
  misc_feature: GZ8MTXP01EZVVE.39.85.H08.1.454.CMB.2.raw
  modified_base (479)..(479): a, c, t, g, unknown or other
  modified_base (494)..(494): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcacctttgacaagtgtgccatgacctgggtccgccaggctccagggaaggggctggagtggggtctcagttattagtggtagtggtagtagcacagattacgcagacctccgtgaagggccggttcaaccatctcccagagacaattccaacagcacgctgtatttgcacatgaacagcctgagagccggaggacacggccatatattattgtgcgtaaacttccttttgaactggtttatnttcccctagtgaccncttgggggccagggaaccctgggtcaccgtcttcctc

SEQ ID NO: 397598 - DNA, 544 bp, Homo sapiens
  misc_feature: GZ8MTXP01B7SN7.39.85.H08.1.454.CMB.2.raw
  modified_base (407)..(407): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgagggaaggggctggagtgggtctctagtttatagtggtagtggtagtagcacagattacgcagacctccggtgaacggggccgttcaaccatctcagagacaattccaacagcacgctgtattgcacntgaacagcctgagagccgggagacacgccatatattattgtgtctaaactttcctttgaacttgttacttacttccccgtagtcgaccgttcgttcggggcccacggggtaaccctggtccaccgtcgttccctccg

SEQ ID NO: 397599 - DNA, 561 bp, Homo sapiens
  misc_feature: GZ8MTXP01A8IB3.39.85.H08.1.454.CMB.2.raw
  modified_base (341)..(341): a, c, t, g, unknown or other
  modified_base (392)..(392): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgcaggctccgaggggaggggctggagtgggtctcgagtttattaggtggtagtggtagtagcacagattacgnagacctccggtagaacggggccgttcaaccatctccagagacaattccaangcacgctgtattgcacatgaacagcctgacgacgccggggaaggacacggacaatatattatgtacgtacgtaaactttccgtttgaacttggttattacgttccccgtaagtcgaccgcggttcggggaacccacggggtaaccctgggtccacccgttcttccctcg

SEQ ID NO: 397600 - DNA, 773 bp, Homo sapiens
  misc_feature: GZ8MTXP01CQI9M.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattctacctttgacaagtgtgccatgaccgtgggtcccgccaggctccgaggggagggctggagtgggtctcgtagttagtagtggtagtggtagtagcacgagattacgcagtacccgtccggtaggaacggggtcccggttacaaaccgtactccgtacccaaaggaacgaacctaaacttacccgaaaacacggacctaacggtcctttaggttaacttttacggaacctaaaccgtaagttacggaaaaccgtacgggtaccccgtaagggaaacgggacccggggaccccgggggaaaacggggtaaaccccggtaacccggggaccctaaagtttaaaccgtttaaattttaacgtttagggttaccggtaaaccccggtttaaaacctttttccccgtttttaaggtaacccgttttaggttttaaactttacccgttacccccgttaaggtaccgttaacccgttcggttacgggggtaacccaaacggggtaaccccttcgggtacccacccggttccttccccgtaaccg

SEQ ID NO: 397601 - DNA, 550 bp, Homo sapiens
  misc_feature: GZ8MTXP01AVHZ0.39.85.H08.1.454.CMB.2.raw
  modified_base (517)..(517): a, c, t, g, unknown or other
  modified_base (545)..(545): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctggtccgcaggctccgagggagggctggagtgggtctcagtttattagtggtagtggtagtagcacagattacgcagaccctccggtaggaacgggtcccggtcaaccatctaccagacgacaattccaacacgcacgctgtatttgacacatcgaacagcctggacgaggccggaagggaccacgggacctagtaagtacttagttgtcgtacgtaaactttcctttagcttggttatcttcccgtagtcgaccngttcgggccagggaacctggcaccgtcncgtcg

SEQ ID NO: 397602 - DNA, 542 bp, Homo sapiens
  misc_feature: GZ8MTXP01AE16G.39.85.H08.1.454.CMB.2.raw
  modified_base (348)..(348): a, c, t, g, unknown or other
  modified_base (388)..(388): a, c, t, g, unknown or other
  modified_base (390)..(390): a, c, t, g, unknown or other
  modified_base (432)..(432): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcaccttgacaagtgtgccatgacctgggtccgccaggctccgagggaaggggctggagtggtctcagttattagtggtagtggtagtagcacagattacgcagacctccggngaaggggcccggttcaaccatctccagagacaattccaanancagctgtattgcacatagaacagcctgagacgccggaggacncggaccatatattatgtgtacgtaaacttcctttgaacctggttactacgttccccgtagtcgaccgcgttcggggccagggtaacccgtggtccaccgtcttccgtccg

SEQ ID NO: 397603 - DNA, 536 bp, Homo sapiens
  misc_feature: GZ8MTXP01AN9NM.39.85.H08.1.454.CMB.2.raw
  modified_base (269)..(269): a, c, t, g, unknown or other
  modified_base (345)..(345): a, c, t, g, unknown or other
  modified_base (404)..(404): a, c, t, g, unknown or other
  modified_base (497)..(497): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccnccaggctccgagggagggctggagtgggtctcagttatagtggtagtggtagtagcacagattacgcagacctcgngacggccgttcaaccatctccagagacaatcaacagcacgctgtattgctacatgaacngcctagagagccggggaaggacacggaccatatattattggtcgtacgtaaactttcctttgaacttggtttactcttcccgtagtcgaccgngttcggggccacgggaacctgggtcaccgtcttccgtcc

SEQ ID NO: 397604 - DNA, 715 bp, Homo sapiens
  misc_feature: GZ8MTXP01EZ1GS.39.85.H08.1.454.CMB.2.raw
  modified_base (344)..(344): a, c, t, g, unknown or other
  modified_base (441)..(441): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgacggggtccctgacgactctcctgtgaacgcctctggattcactttgacaagtgtgccatgaccgtggtccgcaggctcgagggaggggctggagtgggtctcgtagtttagttaggtggtagtggtagtagcacagatacgnacgacgtcgtagaggccgtcaaaccagtctaccgagacgactaacgttaccaaacacggacacggtcttagttactttgacaacgtaatacgaaacncggaccgtaggaaggaccggaccggggaacgggaaccgaaacccgggtacctaaatttaaattaacgtttttaacgttaggttacgggtaaacccgtttaaaaccctttttcccggttttttaagaacccggtttttagggtttttaaactttaaccccgtttaccccggtaagggtttaccggaaaccccggttacgggttaccggggggaaccccgtaacgggggtaaacccccttgggggtacccttaccccggttccgttcccctaaccg

SEQ ID NO: 397605 - DNA, 561 bp, Homo sapiens
  misc_feature: GZ8MTXP01BHAK8.39.85.H08.1.454.CMB.2.raw
  modified_base (444)..(444): a, c, t, g, unknown or other
  modified_base (465)..(465): a, c, t, g, unknown or other
tcagtcgcactagtcacgaccggtgctcgatttagtatcactcagtcgcggtgaggacactgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctggtccgcaggctccgagggagggctggagtgggtctcagttattagtggtagtggtagtagcacagattacgcagaccctcgtagaacggccgttcaaccatctaccgagagacaattccaacagcacgctgtattgcacatagacagcctgagacgcggagacacggacatatattattgngtacgtaaactttccgtttanaacgttaggtttatacttccccgtaggttcgaaccgttcgttcgggggaaccccagggtaaccccttgggccttacccggtccttcccgtaacccg

SEQ ID NO: 397606 - DNA, 732 bp, Homo sapiens
  misc_feature: GZ8MTXP01CRYJF.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctgtgattcacctttgacaagtgtgccatcgaccgtgggtccgccaggctccgaggggaacggggctggagtgggtctcgtagttattaggtggtagtggtagtagcacgagacttacgcacgaccgtccggaggacggggcccgttacaaacctactctaccagaacgactaaacttcccaaacacgcaccgtcttagttatttcggactaacgtataggaaacacggccctaggaacggacggcccggggaaacgggaccgtaaccgggacctaaagttaacttaagtttagttacggttacggtaacccgtttaaaaccgtttttcccgtttttaaggtaaccgttttcggggtttaaacttttacccgttcccccggttaaagggttccggttaaaccccggttaacgggtttcccggggggaaccccgtaaaaccgggggttaacccccgttcgggggttaccccttaacccggtttcccttaaccccgttaaccccgg

SEQ ID NO: 397607 - DNA, 669 bp, Homo sapiens
  misc_feature: GZ8MTXP01D7BQ0.39.85.H08.1.454.CMB.2.raw
  modified_base (268)..(268): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggtattcacctttgacagtgtgccatgactggtccncaggctcgagggagggctggagtgggtctcgagtttagttagtggtagtggtagtagcacgagattacgcagtaccctcggtagaacgggtcccggttacaaacccgatcctaccgaagaacgaacctaaacttacccaaacacgtaccacggtcttaggttatttgactaacgtatacggaaacctagcccgtaggaacgacggacccgggggaacgggaaccgacgggaccctaaagttataatttagtttagtcgtaaccgttaaaccttttccgttttaggaacctttgggtttaactttaccgttccccgtaagttccgaacccgttacggttacgggggaacccctaaacgggggtaaccccttgggtacccttaccggttccgttccctaaccg

SEQ ID NO: 397608 - DNA, 846 bp, Homo sapiens
  misc_feature: GZ8MTXP01DXH6S.39.85.H08.1.454.CMB.2.raw
  modified_base (270)..(270): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacaagtgtgccatgacctgggtcccnccgaggatccgaggggaagggcgtggaggtggtctgagttattaggtggtagtaggtagtagcaacagtattacgcagaccttcccggtaggaacggggtcccgttacacccgtaatcctaacccgaagaacgaaacctaaactttccccaaacgacggaccctaacggtccttaggtttaactttacggacctaaactaaagttacggaaaacccgacggtacccgtagggaaacggaacccggggaacccgggaaacggggggtaaaccccgtaaccggggtaacccttaaagtttaaacgtttaaacgttttaacggttttaaccgggtttaaccggtttaaaccccggttttaaaacccgttttttccccggttttttaaacggttaaccggtttttaacgggtttttaaaccttttaaccccgtttaaccccggtttaaacgggttacccggtaaccccggttaccggggttacccggggggttaaccccggtaaacccgggggttaaccccggtttccggggttacccctaccccgggttacccctttaaccccgttaacccgtaacccg

SEQ ID NO: 397609 - DNA, 664 bp, Homo sapiens
  misc_feature: GZ8MTXP01BS0IG.39.85.H08.1.454.CMB.2.raw
  modified_base (333)..(333): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgagcctctgattcacttgacagtgtgccatgacgtggtccgcaggctccgagggagggctggagtggtctctagttattagtggtagtggtagtagcaacagtattacgnacgtacccgtccggtaggaacggggtcccggttacaaaccctactccgacccgaagacgaacctaacttacccaaacacgaccacgtccttaggttatttcgactaactatagaaacagcctaggaacgacggccggggaaggaccgaccggtcctaaattaactagtttagttacgtacgtaacccgttaaacgtttttcccgttttaggaacgtttacggttttaacgtttacccttaccccgttaaggtccgttaacccgttacgggttcgggggtaaccccacgggggtaaccctcgggtacccttacccggttccttccccgtccg

SEQ ID NO: 397610 - DNA, 668 bp, Homo sapiens
  misc_feature: GZ8MTXP01D736Q.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctcgtggattcacctttgacaagtgtgccatgacctgggtccgcaggctcgagggagggctggaggtggtctcgtagtttagttaggtggtagtgggtagtagcacagtattacgcagaccctccggtaggaaacggggtcccggttacaaaccctatccgtaccgaagacgaactaattaccaaacacgccaacgtcttagttatttcgactaacatacgaaactacgacctaggaacggacggaccggggaacgggaccgaccgggacctaaagttaagttaagtttaagttcggtacgtaaccgttaaacctttttcccgttttaggaaccttttgggttaactttaccgttccccgtaggtaccgacccgttacgggttcggggaacccgtacggggaaccccttgggtacccgaccgttcccgttccctaacccg

SEQ ID NO: 397611 - DNA, 637 bp, Homo sapiens
  misc_feature: GZ8MTXP01DOZIL.39.85.H08.1.454.CMB.2.raw
  modified_base (343)..(343): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccacacgcatgtgacctcaggggtccctgagactctcctgtgaagcctctggattcacctttgacaagtgtgccatgaccgtgggtccgccaggcctccgaggggaggggctggagtgggtctcgtagtttataggtggtagtggtagtagcacagtatacgnacgacctcgtaggaagggtcccgtcaaccatctacagacgacaacttccaacacgcacgtcttagtatttgacaactatacgaacacgcctaggacgacggaccggggaacggaccgaacggacctaagtaattagtttacgttggtacgtaccgttaaaccgtttccgttttgaaccgtttggtttaactttaccgttaccccgttaaggttcgaacccgttacggttaccgggggaacccgtaacggggtaaccccgttgggtccccttaccggtttccttccccgtaaccg

SEQ ID NO: 397612 - DNA, 567 bp, Homo sapiens
  misc_feature: GZ8MTXP01AHG1Y.39.85.H08.1.454.CMB.2.raw
  modified_base (423)..(423): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcaccctttgacaagtgtgccatgacctgggtccgccaggctccgagggaaggggctggagtgggtctcagttattagtggtagtggtagtagcacagattacgcagacctccggtgaaggccggttcaaccatctccagagacattcaacagcacgctgtatttgcacatagaacacgcctagagngaccgggaggacagggcctaatagtattagttgtgtacggtaaactttcctttggaacttggtttattacttccccgttagtcgaccgttcgttacgggggcccagggtaaccccgtgggtcccaccggtccttcccgtaaccg

SEQ ID NO: 397613 - DNA, 570 bp, Homo sapiens
  misc_feature: GZ8MTXP01CVRQP.39.85.H08.1.454.CMB.2.raw
  modified_base (268)..(268): a, c, t, g, unknown or other
  modified_base (364)..(364): a, c, t, g, unknown or other
  modified_base (369)..(369): a, c, t, g, unknown or other
  modified_base (378)..(378): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacagtgtgccatgacctgggtccncaggctccgagggagggctggagtgggtctgagtttattagtggtagtggtagtagcacagattacgcagccctcggtggaaggccgtcaacatcncaganacatccaangcacgctgtatttgcaacatacgaacagcctaggacgagaccggggaggaaccgacggccaattatatttattgtgtacgtaaactttccgttttgaactttggtttattacttccccgttaagtcgacccgttcggttcggggtcccaacggggtaaccccttggggtcccacccgttcttcccgtaaccg

SEQ ID NO: 397614 - DNA, 594 bp, Homo sapiens
  misc_feature: GZ8MTXP01CKOQ0.39.85.H08.1.454.CMB.2.raw
  modified_base (339)..(339): a, c, t, g, unknown or other
  modified_base (383)..(383): a, c, t, g, unknown or other
  modified_base (390)..(390): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacagtgtgccatgacctgggtccgcaggatccgaggggaagggctgggagtgggtctgagttattaggtggtagtggtagtagcacagattacgnagactccgtaggaggccgttcaccaatcctcagagacatccaanagcacgntgtatttgacacagtacgaacagccgtagaacggacgaccggaggggacaaccgggcctaattaaattcgtttaagtggttacgaccttaaactttccttttgaccgtttggttaacttacttccccttagttacgaccgttacgttcgggggaccaacggggtaacccctcgggcctacccggttcctcccttccgtaacccg

SEQ ID NO: 397615 - DNA, 703 bp, Homo sapiens
  misc_feature: GZ8MTXP01ASQBC.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacagtgtgccatgacctgggtccgccaggctccgaggggaggggctggagtgggtctcagtttattaggtggtagtggtagtagcacgagtattacgcagtaccctccggtaggaacggggtcccggttcaaaccctatccgtaccaagaacgaactaacttcccaaacagccaacgtctagtactttgctaacatacgaaaccagccctaggaacggacgacccggggaagggaccgaaccgggaccctaaattagtttaacgtttagtttaggtacgtaaccggttaaaaccttttccgttttaggaaccgttttgggttttaactttaacccgtttacccccgttaaggttaccggttaaccccgttacgggtttaccggggggaacccctaacgggggtaaacccccttcgggggttaccccttaacccccgggttccttccccgttaaccccg

SEQ ID NO: 397616 - DNA, 606 bp, Homo sapiens
  misc_feature: GZ8MTXP01EJSLQ.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacaagtgtgccatgaccgtggtccgcaggctccgaggggagggctggagtgggtctcgagtttattaggtggtagtgggtagtagcacagattacgcagacccgtccggtaggaacgggcccggttacaacccgatcctccaagacgactaacttccaaacagacacgtctgtatttgacaactatacgaacagcctgagacgacggggagacacggacatatagttagttgtacgtacgttaaactttcctttgaacgtttggttacttacgttccccgtaggtccgttaccgttcgggttacggggaacccgtaacggggaacccctttcgggccttacccgtcctttcccgtaacccg

SEQ ID NO: 397617 - DNA, 730 bp, Homo sapiens
  misc_feature: GZ8MTXP01B2TY6.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcaccctccacgccgtccacgtaccagttgaacttgacctcagggtcttcgtggctcacgtccaccaccacgcatgtgacctcgaggggtccctgagactctcctgtgaagcctctgattcacctttgacagtgtgccatcgaccgtggtccgccaggctcgaggggagggctggagtgggtctcgtagttagtggtggtagtggtagtagcaacagattacgcacaccgtccggtaggaacgggtcccggttacaaacccgtacgtccgtaccaagtaacggaacctaaagttacccaaacgtacgaccctacgtacgttagttaagttttacgactaaccgagttacgaaacgtacgacccgtaaggaacggaccggacccgggggaaacggaacccgaacgggtacccgtaaattaacgttaatttagttacggttacgtaaccggttaaaacttttcccgtttttaagaacggttttcggtttaaactttaccgttaccccgttaagggtttccgaacccggttaccgggttaccgggggaaccccgtaaccggggttaaaccccgttcggggttaccccgttacccggttcccttccccgtaaccccg

SEQ ID NO: 397618 - DNA, 804 bp, Homo sapiens
  misc_feature: GZ8MTXP01CNSSA.39.85.H08.1.454.CMB.2.raw
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgagggtccctgagactctcctgtgaagcctcgtggtattctacctttgaactaagtgtcgcctagtcgacccgtcggggtcccgaccgacggccgtaccggaagggggaacggggcgtgggaggtgggtctacgtagtttagtaggtggtagtggtagtagacacgagtagttacgacaggtaccgtccccggtaggaaacggggtcccggttaccaaccgtaacgttccctaaccgaaagaaacgaaacctaaacttacccaaacgacgaccctaacgtcttaggttatttcgacaacgtaagtacggaaaccgacggaccgtagggaacggaccgggaaccgggaacgggggtaacccggaaccggtaaaccttaaagtttaacgtttaaacgtttaacggtttacgggtttaaaccgttaaacccgttttaaacccgtttttcccgttttaaggtaaccgttttaacggttttaaacccttacccgttaccccgttaaaggtacccgtaacccggttccggggttacccggggaacccggtaacccggggtaaccccgttcggtaccccgtacccgttccctaaccccgttaaccgtaacccg

SEQ ID NO: 397619 - DNA, 785 bp, Homo sapiens
  misc_feature: GZ8MTXP01DOIVR.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggtattcactttgacaagtgtgccatgaccgtgggtccgcaggctccgaggggaagggctggagtgggtctcgtagtttagtaggtggtagtggtagtagcacgagtattacgcaagaccctccggtagaacggggtcccgttacaacccgtaatcccgtaccaaggaacgaactaaacttcccgaaaacgtaggaccctaacggtccttagttaaacgttttcggacctaaactaacgttacgaaaaccgacgaccccgttaaggaacggaaccggggacccggggaaacggggaaacccgtaacccggggaacccttaaaggtttaaactttaacgttttaaggtttaccggttaacggttaaacccggttttaaaaaccccttttttcccgtttttaagggtaaaccgtttttacggggttttaaactttttacccgttaccccccgtttaaagggtcccgttaaacccccggttaggttcgggggttaacccgaacggggtaacccccgttgggttacccttaccccggttccttcccgttaaccccgg

SEQ ID NO: 397620 - DNA, 664 bp, Homo sapiens
  misc_feature: GZ8MTXP01ECHCR.39.85.H08.1.454.CMB.2.raw
  modified_base (381)..(381): a, c, t, g, unknown or other
  modified_base (402)..(402): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggtattctacctttgactaagtgtgcatcgaccgtggtccgcaggctcgaggggagggctgggagtggtctgtagtttagtagtggtagtggtagtagcacgagtattacgcagtacctccggtaggaacgggtccgttacaaccatcncaagacgaactaactccaaanacgcacgtcttagttattcgacaacagtacaaacgacggccgtaggaacgaccgggaccggggtaacggaacccgtaacggaccttaaattaattagttttagttacggttagtacccgtttaaaccttttccgtttagtaaccgtttaggtttactttacccgttaccccgtaagttacccgaaccgttccgggttagggggaaccccgtaacggggtaaccccgttcggaacccgttccccgttccgttccccgtaaccg

SEQ ID NO: 397621 - DNA, 718 bp, Homo sapiens
  misc_feature: GZ8MTXP01CN7EQ.39.85.H08.1.454.CMB.2.raw
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggtattcactttgacgaagtgtgccagtcgaccgtgggtcccgccgaggccgtccgaagggggaggggcgtgggaggtgggtctcgtagtttagttaggtgggtagtggtagtagacgagagtacttacgacgagtaccgtccccggtagggaacggggtcccggttacacccgtaaacttccctcccgaagaaacgaactaaacgttacccaaacgtacgactaaccgtcgttaggttaactttcgacctaactaagtacggaaactacggccgtagggaacgacggacccggacgggggaacgaccggtacctaagttaattagttacgttaggtacgtaaccgtttaaaccgttttcctttacggtacgttaacggtttaacttaccgttaccccgttagtaccgtaccgttaccgggttcgggggaccccgtaacgggggtaccccttcgggtccctacccgttcccgtcccttcgtaacccg

SEQ ID NO: 397622 - DNA, 663 bp, Homo sapiens
  misc_feature: GZ8MTXP01CCDOX.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgagcctctggattctacctttgacaagtgtcgccatgacctgggtccgccaggcctcgaggggaggggctggagtgggtctcgtagtttattaggtggtagtggtagtagcacagattacgcagaccctccggtaggaacggggtcccgttacaaccctatcctacaagacgactaacttccaaacacgcacgcttgtatttcgactaacgagtagaacaggtccctggaacgacgggacccgggaagggaccgaaccggtcctaaattacgttaatttagtttcggtacgtaaccggttaaaccttttccgttttaggaacgttttgggttaaacttttaccgttccccgttaaggtccgttaacccgttcgggttaccgggggcccgtaaccgggggtaaccccttcgggtacccttacccgtccttccccgtaaccg

SEQ ID NO: 397623 - DNA, 643 bp, Homo sapiens
  misc_feature: GZ8MTXP01EF6K5.39.85.H08.1.454.CMB.2.raw
  modified_base (264)..(264): a, c, t, g, unknown or other
  modified_base (293)..(293): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccacaccacgcatgtgacctcaggggtccctgagactctcctgtgaagcctctggattcacctttgacaagtgtgccatgactggccncaggatccagggaagggctggagtgggtntcagttattaggtggtagtggtagtagcaacgagattacgcagacttccccggtgaaaggggcccgttcaccgaatctccgagaacgacaaattccaacaggaccacgcttaggtaactttggacccaagtaattcggaaaaccacggaccgtagggaacggacggacccggaaggggaaccgacggtaaccaagttaacttaagtttagttcggtacgtaaccgttaaaccttttccgtttaggactttaaggttaacttaccgtccccttaggtaccgtacccgttacggttccgggacccgtaaccgggtaccctcggtccctaccgttccttaacccgcgaacccg

SEQ ID NO: 397624 - DNA, 605 bp, Homo sapiens
  misc_feature: GZ8MTXP01AT90N.39.85.H08.1.454.CMB.2.raw
  modified_base (332)..(332): a, c, t, g, unknown or other
  modified_base (424)..(424): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgaccgtggtccgccaggctccgaggggaaggggctgggagtgggtctctagtttagtagtggtagtggtagtagnacagattacgcagaccctccggtaggacgggtccggtcaaccatcctcccaagagacaacttcaaacagcacgctgttagttgacacagtanaacacgcctagagacgaccgggaaggaccaaccggcctaagttataatttacgttagtcgtaaccggttaaaccttttccgtttagtaacgttaggtttaacttaccttcccgttaggtcacccgttacggcggggaacccgtacggggaacccttggccgttaccgtccgttcctaaccg

SEQ ID NO: 397625 - DNA, 695 bp, Homo sapiens
  misc_feature: GZ8MTXP01AIOL5.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcactttgacaagtgtgccatcgaccgtgggtcccgcgaggctaccggaggggaagggctgggagttgggtctcgtagtttagtaggtggtagtggtagtagcacagtacttcgacagtacccgtccggtaggaacggggtcccgttacaacccagtcctaccgaagaacgaactaacgttacccaaacgtacgacctaacggtctttaggttaactttcggacaacctaatacgaaacgacgtccgtaggaacgacggaccgggggaaggtaccgacggacctaagttaattagtttagtacggtacgtaccgttaaacccttttccgtttaaggtaacgtttacggttttaacttcccgttaaccccgttggtaacccgttacccgttacggggttccggggaaccccgtaccggggtaaccccttgggtacccttacccgtccgttccctaacccg

SEQ ID NO: 397626 - DNA, 755 bp, Homo sapiens
  misc_feature: GZ8MTXP01D76US.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgactaagtgtgccatcgacctggtccgcaggctcgagggagggctggagtggtctgtagttattagtggtagtggtagtagcacgagtattacgcacgacctcggaggaacgggtcccgttacaaacccgatccgtaccgaaaggaacgaacctaaacgttaccccaaacgacgaccgtaacgtccgttaggttaacttttacggacctaaacctaagtacggaaaccacggtccctaaggaacgggacccggacccggggaaacggggaacccgaaacccgggtaccctaaagttaagtttaactttaagtttcggttaaccgtaaccggtttaaaaccctttttcccgttttaaggtaacccgtttagggttttaaacttttaacccgtttacccccgttaaaggtttacccggaaaccccggttacgggttccggggggaacccctaaccggggggtaaccccttccgggggtacccgttaccccgtttccgttccccgttaaccccg

SEQ ID NO: 397627 - DNA, 639 bp, Homo sapiens
  misc_feature: GZ8MTXP01CRWGR.39.85.H08.1.454.CMB.2.raw
  modified_base (424)..(424): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaacgcctctggattctacctttgacaagtgtcgcatcgaccgtcgggtcccgccgaggctcgaggggaggggctgggaggtggtctcgtagtttagttaggtggtagtggtagtagcacagtatacgcagaccgtcggtagacggccgtcaaccatctacagacgacactaccacagcagctgtattgacatatagaacncgtcgtagacgacgaccggggaggaccgcggacctagttactagtttagtggtcgtaaccgttaaacttttccgtttggtaacgtttcggtttaactttacccgttacccccgttaagggtcccgaacccggttcgggttaccgggggaaccccgaaacgggggttaacccctggggtaccccttacccgggttcccgttaaccctaaccccggg

SEQ ID NO: 397628 - DNA, 850 bp, Homo sapiens
  misc_feature: GZ8MTXP01DEIDN.39.85.H08.1.454.CMB.2.raw
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgaacgcctctggtacttcacctttgactagtgtgccatcgaccgtgggtcccaccgaggactccggaggggaacgggcgtgggaggtgggtctcgtagtttagttaggtggtagttaggtagtagacaacgagtattacgactagaccgttccccggaggaacgggtcccgttacacctaactctccgagaacgtaaacctaaacgttacccaaacgacgtaccctaacgggtcctttaggtttaactttacggacctaaacgtaacgttaccggaaacgaccgggtacccgtaagggaaacggaaccgggaccccgggaaaggggggttaaccccgaaacccggggtaaacctaaaggtttaaacgtttaaattttaaccggtttagggttaaaccgttaaaccggtttaaaacccttttttcccggttttacgggttaaaccgtttttaaggggttttaaacccttttacccggttaaccccggttaacggttaacccggtaaccccgggttaccgggtttcccgggggggaaccccgtaaacccgggggttaaacccccgtttcggggttaaccccccgtaaccccggggtttccccttccccggttaaccgggtaaccccccg

SEQ ID NO: 397629 - DNA, 619 bp, Homo sapiens
  misc_feature: GZ8MTXP01DG4LW.39.85.H08.1.454.CMB.2.raw
  modified_base (231)..(231): a, c, t, g, unknown or other
  modified_base (270)..(270): a, c, t, g, unknown or other
  modified_base (299)..(299): a, c, t, g, unknown or other
  modified_base (395)..(395): a, c, t, g, unknown or other
  modified_base (398)..(398): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgaggggtccctgagactctcctgtgaagcctntgtattccacttgacaagtgtgccatcgaccgtggtccncgaggctcgagggaggcgtggagtggtcntagttagtgtggtagtggtagagcagagtattacgcgagaccgtcccgtaggacgggtccgtaccacgtaatcctcaggactaactaactaccaanacncctaacgtcttaggttacttcgacaacgtagtacgaacacgtaccgagaacgacgtacccggaagggaccgacggactagtaattattgtgtacgtaacgttaaccttttcgtttgacgtttaaggtttaacttcctacccgttagtaccgtaaccgcggttcggggacccgtaacgggtaacccgttggacccctaccggttccttcccgcgtaaccccg

SEQ ID NO: 397630 - DNA, 642 bp, Homo sapiens
  misc_feature: GZ8MTXP01DYQX0.39.85.H08.1.454.CMB.2.raw
  modified_base (234)..(234): a, c, t, g, unknown or other
  modified_base (238)..(238): a, c, t, g, unknown or other
  modified_base (272)..(272): a, c, t, g, unknown or other
  modified_base (346)..(346): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgccacctccacgccgtccacgtaccagttgaacttgacctcgagggtcttcgtggctcacgtccaccaccacgcatgtgacctcgacggggtccctgacactctcgtgtgaagcctntgtnttcacttgatagtgtgcatcgaccgtgggtcccncgaggctccggaagggagggctggagtggtctgtagtttataggtggtagtggtagtagcacgtagtactacgnacgtaccgtccggtaggacgggtcccgttacaaacctactcgtaccgagtaacgaaactaccttaccaaacgtagacctacgtacttagttaactttcggactaaacctagtacgaaaaccgtcgaccgtaggaacgacggacgggaacggactaccggactagtacttgttagtagtacgtaaccgttaactttccgtttagaacgtttagtttactaccttcccgtagtcgacccgttgggttccgggaacccgtaacggaacccgttggacccttaccgtcttcccgtaaccg

SEQ ID NO: 397631 - DNA, 710 bp, Homo sapiens
  misc_feature: GZ8MTXP01EE57K.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgccacctcccacgccgtccacgtaccagttgaacttgacctcagggtcttcgtgctcacgtccaccaccacgcatgtcgacctcgaggggtccctgacgactctcctgtgaacgcctcgtggtacttcaccttttgactaagtgtcgcctatcgaccgtgggtcccgccgaggctccggaaggggacgggtctggagtggtctagtagtttagtagtggtagtggtagacgtacaacgtagtaacttaccggactaacggtaccccgttaccggtaggaaccggggtcccgtttacaaaccctactccgtacccgaagggaactaacctaaacttaccccgaaacgaacgtccgaacgtcgttaggttaactttcgacctaaccgtagtacgaacgacgtacccgtagaacggacggaccggggaacggaaccgtaccggacctaattaattaagtttagttacgttacgtaaccgttaaaccttttcgtttagtaacgtttaggtttacttaccttacccgttagtacgacccgttacggttccgggaacgaccgggtaacccgtcggtaccacccgtccttccgtaacccg

SEQ ID NO: 397632 - DNA, 752 bp, Homo sapiens
  misc_feature: GZ8MTXP01BCCO0.39.85.H08.1.454.CMB.2.raw
  modified_base (233)..(233): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctgagactctcgtgtgacgcctntgattctacctttgacagtgtcgcatcgaccgtggcccgcgaggcctacggaggggagggcgtaggagtgggttctacgtagtttagttaggtggttaggtagggtagtacgacgaacgtagtaacgttaccgactaacggtacccccgttcccgggtaggtaaaccgggggtccccgtttaccgaaacccgtacttcccgtaccgaaagtaaaccgaaacttaaacctaccccgaaagacgaccctaacgtcgttacgttattcggactaaccgtagtacgaaacgacgccgtaaggaacggtaccgaccgggggaacgtaccggaaccgtactaaagtttaacgttatttagtttacgtcgtaaaccgtttaaaccgttttccgttttaggtaactttagggttttaaccttacccgttaccccgtaagttaccggttaaccgttaccgggttccggggaacccggtaaagggtcccccgttagggtaccccttaccggtcccttaacccgaacccg

SEQ ID NO: 397633 - DNA, 528 bp, Homo sapiens
  misc_feature: GZ8MTXP01EGC1Z.39.85.H08.1.454.CMB.2.raw
  modified_base (266)..(266): a, c, t, g, unknown or other
  modified_base (362)..(362): a, c, t, g, unknown or other
  modified_base (380)..(380): a, c, t, g, unknown or other
  modified_base (386)..(386): a, c, t, g, unknown or other
  modified_base (394)..(394): a, c, t, g, unknown or other
  modified_base (398)..(398): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtcaccaccacgcatgtgacctcaggggtccctgagactctcctgtgaagcctctggattcacctttgacagtgtgccatcgactggtccncagctcgagggagggctggagtgggtctcgagttattagtggtagtggtagtagcacagattacgcagacctcggtgaaggtccgtcaaccatccncaagagacaactcaaacngcactntgtatttnacanatagacagacgagagacgacggagacgacgacatatattatagtgtactacttactttgtaatgttattacttaccgtacgtcgacgcgacggaacgacggtaaccgtcgtcgttaccgtcgttccgtcg

SEQ ID NO: 397634 - DNA, 726 bp, Homo sapiens
  misc_feature: GZ8MTXP01AUSRR.39.85.H08.1.454.CMB.2.raw
  modified_base (230)..(230): a, c, t, g, unknown or other
  modified_base (347)..(347): a, c, t, g, unknown or other
  modified_base (387)..(387): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgagggtccctgagactctcctgtgaagtcctntggattcacctttgacaagtgtcgcatcgacctgtcgtccgcgaggctccgaggggagggctgggagtggtctcgtagtttagtagtgggtagtggtagtagcacgagtattaccgnacgtacccgtcggtaggaacggggtcccggttacaaaccncgtccgtacgaaaggtaacgaactaaactccaaacgaggtccaacgtcgttgttaacgtttcgaacctaacgtaagtaccgaaaccgtacgtccccgtaagggaaccggaccgggacccggggtaaacgggaaaccctacggggaacccctaaattaaccgttaactttagttacgggtacgttaaccggtaaaccttttccgttttaaggtaacccggtttaggttttaaacttcccgttacccgttacgggtaccgacccggttacgggttcccgggggtaaccgaacccggggtaaccgttccgtacccggttcccgttaacccttcgtaaccccg

SEQ ID NO: 397635 - DNA, 913 bp, Homo sapiens
  misc_feature: GZ8MTXP01BUPPR.39.85.H08.1.454.CMB.2.raw
tcagtcgcactagtcacgaccggtgctcgatttagtatcactcagtcgcggtgaggacgctgaccacacggtacgtgctgttgtactgctcctcccgcggcttttgtcttggcattatgccacctccacgccgtccacgtaccagttgaacttgacctcagggtcttcgtgctcacgtccaccaccacgcatgtacgacctcgacgggtccctgacgtacctctcctgtagacgtcctgtgtattcctacttgactagtgtcgctagtcgaccgtcggtcccgacgacggccgtaccgggaagggggacgggtcgtagggtacggttcgggttccttacgttaaggttttaaggtttaggggttacgggtttaagggttgggttaacgttaacggactaaacgtagttaaccgttaccggacgtaacggtacccccgttaccgggtaggggtaacccggggttccccgttaccaaacccgttacttcccgtaccgaaaggtaaccgtaaacccttaaaccgttaccccgaaacgtacggtacccgtaaccgttaccgtttagtttaacgtttaccggaacctaaacgtacgttaacggaaaccgtacggttacccgaagggaaacggaaccccggggacccgggggtaaacgggaaaccccgtacccgggtaacctttaaagtttaaccgtttaaacgttttaggtttaccgggttaacgttaaacccccggtttttaaaaccctttttttcccggttttaaggtaaaccggtttttaacggtttttaaacctttaaccccggttaccccgtttaaggtacccggaacccgttacggggttcccgggggaaaccccggttaacccgggtaaccccgttcggtaccccgttacccgttcccttcccgtaacccg

SEQ ID NO: 397636 - DNA, 805 bp, Homo sapiens
  misc_feature: GZ8MTXP01AG7GO.39.85.H08.1.454.CMB.2.raw
  modified_base (239)..(239): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtcgacctcgacggggtccctgacgtactctcctgtagaacgtcctntggtattctacctttgactagtgtcgccagtcggaccgtcggtcccgcgacgggcctaccgggaagggggtaggggtccgtagggtacggttcgggtctacgtagtttaagttaggtggtagtaggtagtagactacgtagtacgttacgcacggtacccgttcggtaggaacgggtccgtaccaaactactcctaccgaagaacgtaacctaacgttaccaaacgtcgaccgtaacgtcttaagttacgttacgactaaccgagttaaccgaaaccgacggttcccgtaaggacggtaaccggccgggggtaaaggaaccccgaccggtaccttaaagttatttaacgtttacggtttacgtaaccgttaaacccgtttaaacctttttcccggttttaggtaacccgtttttacgggtttaaacctttaccccgttaccccgtttaagggccccggttaaacccgggttaccgggttacccggggggtaaccccgtaaccggggttaaccccgtttcccggggttaacccttaccccgggtttcccttccccggttaaccccgg

SEQ ID NO: 397637 - DNA, 819 bp, Homo sapiens
  misc_feature: GZ8MTXP01E0ZKK.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtcgacctcgacggggtccctgacgactctcctgtagaagtcctcgtggtacttcctaccgttttgaactaaggttcgtgaccctattcggaccgttcgggcccgaccgacgggtcctaccggaagggggaacggggtcgtagggtacggttcggggtactacgtaagtttagttaggtgggttaagttgggtacgtacgcgtaacgagtacttacggactagtaccccgtccggtaggaaccgggtccgttaccaaacctagttccgaccgaaacggtaacgtaaccttaaaccttaccgaaacgacgtacctaacggtcttaggttatttacgacttaacaagttcggaaaacctcgtaccgtaagggaacgaaccgggtaccgggggaaacggaaccccgaaccggttaacctaaagtttaacgtttaacgtttagtttaccggtaaccgttaaaccgtttaacgttttccggttttaggtaaccgttttaacgtttaaccgttaacccgtttacccggtaacgtaacccgggttaacccggttccggggttacccggggtaacccggtaaccgggttaaccccgttcggttaccccgttaaccgttcccgttaaccccgaacg

SEQ ID NO: 397638 - DNA, 734 bp, Homo sapiens
  misc_feature: GZ8MTXP01CGBOI.39.85.H08.1.454.CMB.2.raw
  modified_base (285)..(285): a, c, t, g, unknown or other
  modified_base (496)..(496): a, c, t, g, unknown or other
  modified_base (658)..(658): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctccgtgtgaacgccttctggtacttcctactttagaacgtaagtgtcgcagtcggaccgtgggtcccncgacggcgtaccggaggggacgggcgtgggacggtgggtctcgtaggtttatttagggtggttaggttaggttaggtagaccgtaacagtacgttacgacgaacgtaccgttcccccggtaggggaacgggtcccggttacacctaacttccgtccagggacaaacctacgtaaccaacagaccctacgtcttaggttattcgaacctaanaacgtgaaaccggttacccgaggaaccggtacgacccgggtaacggggactaaccggggtacctaagttatttaacgttacgttagttacggtaaaccgttttaaacgtttccttttaggaccccgttttggtttaaacctttccgacccgttaggttaccncggttacccgggcggggacccgtaaaccgggtccccgttaaggtccccgacttccccgttccgcccggtaaccccg

SEQ ID NO: 397639 - DNA, 770 bp, Homo sapiens
  misc_feature: GZ8MTXP01C1TG1.39.85.H08.1.454.CMB.2.raw
  modified_base (232)..(232): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtgaagcctntggtattcacctttgactaagtgtcgcctatcgaccgtcgggtcccgccgacggcctaccggaggggacggggtcgtgggtaggtgggtctcgtaagtttagtaggtggttagtgggtagtacgcaacgtagtacgttaccgcacggtaccccgttaccgggtaggtaacgggggtccccggttaccaaacccgtagttcccgtaccaaagggtaaccgaaactaaccttacccgaaacacggtacctaccgtcgttaggttatttacggacaactacgtagaaaccgacgtaccgtaggaaacgaccgggaccggggaacggggaccgtaaccggtacctaagttaacgtttattagttacggtacgtaaccgttaccctttacgttttcggtaacgtttcggtttaaactttcccgttaccccgttaagttaccggaaccccgttcggggttccccgggggtaaccccggtaaccggggttaaccccgttaccgggtaccgttacccccgggttccgttaaccccggttaaccccg

SEQ ID NO: 397640 - DNA, 547 bp, Homo sapiens
  misc_feature: GZ8MTXP02GCG4A.39.85.H08.1.454.CMB.2.raw
  modified_base (389)..(389): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgagggaagggctggagtgggtctcgagttatagtggtagtggtagtagcacagattacgcagacctccgtgaagggccggttcaccatcctccagacgacaattccaaacngcacgctgtatttgctacatgaacagcctgagagccgaggacacggccatatattatgtgacgtaaactttcctttagacttggtttatttactccccttagtcgaccgtacgtagggggcccagggaaccccttgggtaccaccggttctcctaccg

SEQ ID NO: 397641 - DNA, 515 bp, Homo sapiens
  misc_feature: GZ8MTXP02GTOFD.39.85.H08.1.454.CMB.2.raw
  modified_base (359)..(359): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccagggaaggggctggagtgggtctcagttatagtggtagtggtagtagcacagattacgcagacctccgtgaagggccgttnaccatctccagagacaattccaaacagcacgctgtattgcacatgaacagcctgagagccgaggacacggccatatattattgtgcgaaacttcctttgactggttattatcccctagtcgaccactggggccagggaaccctggtcacgtctctc

SEQ ID NO: 397642 - DNA, 538 bp, Homo sapiens
  misc_feature: GZ8MTXP02JXON3.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccaggggaaggggctggagtggggtctcagttattagtggtagtggtagtagcacagattacgcagacctccgtgaagggccggttcaccatctccagagacaattccaaacagcacgctgtatttgcacatgaacagcctgagagccgaggacacggccatatattatgtgacgtaaactttcctttagacttggttattactcccctagtcgaccacgtcgggggccacggggaaccctgggtccaccggtcctcctccg

SEQ ID NO: 397643 - DNA, 529 bp, Homo sapiens
  misc_feature: GZ8MTXP02I7KZ8.39.85.H08.1.454.CMB.2.raw
  modified_base (403)..(403): a, c, t, g, unknown or other
  modified_base (489)..(489): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgagggaaggggctgggagtgggtctcagttatagtggtagtggtagtagcacagattacgcagacctccgtgaagggccgttcaccatctccagagacaattccaacagcacgctgtatttgcanatgaacagcctgagagccgaggacacggcatatattattgtgcgtaaacttcctttgactggtttattactcccctagtcgacccngtaggggccaaggggaacccctggtccaccgtctacctcg

SEQ ID NO: 397644 - DNA, 526 bp, Homo sapiens
  misc_feature: GZ8MTXP02G2214.39.85.H08.1.454.CMB.2.raw
  modified_base (270)..(270): a, c, t, g, unknown or other
  modified_base (383)..(383): a, c, t, g, unknown or other
  modified_base (492)..(492): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcacctttgacaagtgtgccatgacctgggtccncaggctccgagggaagggctggagtgggtctcgtagttatagtggtagtggtagtagcacagattacgcagacctcgtgaagggccgttcaccatctccagagacaatccaanagcacgctgtattgcacatgaacaggcctaggagagccggaggacacggaccatatattattgcgacgtaaactttctttagacttggttattactccctagtcgaccngtcgggccacgggacctcggcaccgtctccgtac

SEQ ID NO: 397645 - DNA, 530 bp, Homo sapiens
  misc_feature: GZ8MTXP02IOJEK.39.85.H08.1.454.CMB.2.raw
  modified_base (386)..(386): a, c, t, g, unknown or other
  modified_base (525)..(525): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctggtccgccaggctccaggggaaggggctggagtggggtctcagtttattagtggtagtggtagtagcacagattacgcagacctccgtgaagggccggttcaccatctccagagacattccaanagcagctgtatttgctacatgaacagcctgagagccgaggacacggccatatattattgtgcgtaaacttcttttgacttggttattacttcccctagtcgaccacgttgggccaggggaaccctgggtccaccggtcncctcg

SEQ ID NO: 397646 - DNA, 538 bp, Homo sapiens
  misc_feature: GZ8MTXP02G7W2E.39.85.H08.1.454.CMB.2.raw
  modified_base (423)..(423): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgaggggaaggggctgggagtgggtctcagtttatagtggtagtggtagtagcacagattacgcagacctccgtgaagggccggttcaccatctccagacgacaattccaaacagcacgctgtatttgcacatgaacagcctgagngccgaggacacggcatactattatgtgcgtaaactttcctttgacttggtttattactccctagtcgaacctgtcggggccagggtaacccctggtacccaccggttcctcgtac

SEQ ID NO: 397647 - DNA, 588 bp, Homo sapiens
  misc_feature: GZ8MTXP02IL1SV.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctggtccgccaggctccgagggaaggggctgggagtgggtctcagttattaggtggtagtggtagtagcacagattacgacagacctccgtagaacggggtccggttcacccgatcctccagacgaaccaagttccaaacaggaccacggccttgtaatttgacactatagaaacagacctgaggacgccggaggacacgggaccaagtatattattgtgaccgtaaactttccttttagacgttggtttacttacttacccctagtacgtacctacgtcggggaaccgacggggtaaccctgggtacctaccggtctacccgtaccg

SEQ ID NO: 397648 - DNA, 552 bp, Homo sapiens
  misc_feature: GZ8MTXP02HWR5I.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccagggaaggggctggagtgggtctcagttattagtggtagtggtagtagcacagattacgcagacctcgtgagggccggttcaccatctccagagacaattccaacagcacgctgtattgcacatgaacagcctgagagccgaggacacggccatatattattgtgacgtaaactttccttttagactttgggtttaattacgtacccccttagtcgtaccctacgtcgggggcccgaacggggaacccctggtacctacccgtcttccctaccg

SEQ ID NO: 397649 - DNA, 576 bp, Homo sapiens
  misc_feature: GZ8MTXP02HJDGH.39.85.H08.1.454.CMB.2.raw
  modified_base (367)..(367): a, c, t, g, unknown or other
  modified_base (393)..(393): a, c, t, g, unknown or other
  modified_base (418)..(418): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgaggggaaggggctggagtgggtctcgagttattaggtggtagtggtagtaggcacagattacgcagaccctccgtgaacgggccgttnaccatctccagacgacaatccaaacngacacgctagtattgcacatgaacngcagagacgcgagacacgacatatattagtgtacgtacgtaactttctttagtacgttagttacttaccgtacccgttaggtaccgaacccgtacggtacggggaacccgtaacggggtaaccccgttcgggtaccctacccggttcctacccgtacg

SEQ ID NO: 397650 - DNA, 576 bp, Homo sapiens
  misc_feature: GZ8MTXP02I9COF.39.85.H08.1.454.CMB.2.raw
  modified_base (268)..(268): a, c, t, g, unknown or other
  modified_base (337)..(337): a, c, t, g, unknown or other
  modified_base (366)..(366): a, c, t, g, unknown or other
  modified_base (382)..(382): a, c, t, g, unknown or other
  modified_base (400)..(400): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgactgggtccncaggctccgaggggaaggggctggagtgggtctcagtttatagtggtagtggtatagcacagattacgnagacctccgtgaagggccgttcaccatcnccagagacaatccaangcacgctagtattgcacntagaacagcctagagagccgaggacacggcaatacttatattgacgtacgtaaactttccttttaggacctttagggttactttacgtacccccgttaggtaccgtaaccgaccgttagggggaacccctaaggggtaaccccctggggtccctaaccccggttctacccgtcccg

SEQ ID NO: 397651 - DNA, 661 bp, Homo sapiens
  misc_feature: GZ8MTXP02IT3Z3.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattccacctttgacaagtgtgccatcgacctcggtcccgccgaggctccgaggggaaggggctggaggtgggtctcgtagtttattagtggtagtggtagtagcacgagattacgcagaccctccgtgaacggggtccgttacaaccatcctaccgagaacgaacctaaacttacccaaacacgaccgacgtacttacgttaatttcgactaacagtacgaaacgacgcctagaacgaacgcccggaaggtaccaccgggacctaataataagtttattcgtagtaaccggtaaactttcgttttagtaacgtttaggtttaactttaccgtaccccgttaaggtcccgtaacccgtacggttccggggaacccgtaaaccggggaaccccgttcgggtacccctacccggttccttacccgtccccg

SEQ ID NO: 397652 - DNA, 627 bp, Homo sapiens
  misc_feature: GZ8MTXP02ISY2G.39.85.H08.1.454.CMB.2.raw
  modified_base (335)..(335): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacaagtgtgccatgacctgggtccgccaggctccgaggggaggggctgggagtgggtctctagttattaggtggtaggtggtagtagcanagattacgcagacctccgtgaacgggtccgttcaccatcctaccgagagaccaattccaaacacgcacgcttagttatttgacaactagtacgaaacacgccgtagaacgaggacccggaaggaccgaaccgggacctaaagttaagttaatttaagttgtacgtaccgttaaaaccttttccgtttagtacgttagtttaacttaccttaccccgttagtaccgacctacggtcggggaacccgtacggggtaaaccccgttcggtacccgtacccgttccgtcccgtacg

SEQ ID NO: 397653 - DNA, 573 bp, Homo sapiens
  misc_feature: GZ8MTXP02HKL9D.39.85.H08.1.454.CMB.2.raw
  modified_base (385)..(385): a, c, t, g, unknown or other
  modified_base (397)..(397): a, c, t, g, unknown or other
  modified_base (416)..(416): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcacctttgacagtgtgccatgaccgtggtccgccaggctccgaggggaaggggcgtggaggtgggtctcgtagttataggtggtagtggtagtagcacagatacgcagaccctccggtagaacgggtccggttcaccatcctacaganacaatccaaacngcacgctagtattgactanatagaacagcctagagacggaccgaggaccacggaccatattattatgtcgtacgtaactttcgtttagtacttaggtttacttactcccgttagtcgaccgtacgtcggggaacccgtacggggtaaccctcggtaccacccgtcctaccgtaccg

SEQ ID NO: 397654 - DNA, 568 bp, Homo sapiens
  misc_feature: GZ8MTXP02GTMDZ.39.85.H08.1.454.CMB.2.raw
  modified_base (306)..(306): a, c, t, g, unknown or other
  modified_base (331)..(331): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtcccgccaggatcccgaggggaaggggctgggagtgggtctnagttataggtggtagtggtagtagnacagattacgcagactcccgtgaacgggtccggttcaccatctccagagacaattccaacagcacgtctagtatttgacacatagaacagcctagacgagccggaagacacgggacctaatataattattgtagacgtaaactttcgtttgacttggtttaacttctccccgttaagcgaccgtacgtcggggtccaacgggtaacccttgggaccctaccggtctcctacgacccg

SEQ ID NO: 397655 - DNA, 552 bp, Homo sapiens
  misc_feature: GZ8MTXP02JQ0BL.39.85.H08.1.454.CMB.2.raw
  modified_base (268)..(268): a, c, t, g, unknown or other
  modified_base (346)..(346): a, c, t, g, unknown or other
  modified_base (383)..(383): a, c, t, g, unknown or other
  modified_base (446)..(446): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctggtccncaggctccgagggaaggggctggagtgggtctcagttatagtggtagtggtagtagcacagattacgcagacctccgngaaggccggttcaccatctccagagacaattccaaanagcaacgctgtatttgcacatagaacagcctgagagccgaaggacacggcaatatattattgnacgaaactttcctttagacttggttattactccccgtaagttcgaacctacgtcggggaacctaacggggaaaccccttcgggtaccaccggttcctccctacccg

SEQ ID NO: 397656 - DNA, 546 bp, Homo sapiens
  misc_feature: GZ8MTXP02HRMIO.39.85.H08.1.454.CMB.2.raw
  modified_base (455)..(455): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtcccgccaggctccgaggggaggggctggagtgggtctcagttattaggtggtagtggtagtagcacagattacgcagaccctccgtgaacgggccggttcaccgatcctaccagacgacaattccaaacagcacgctagtatttgcacatgaacagcctgagagccgaggacacggcatagattatgtnacgtaactttcctttgtactggtttattactccccttagtcgacctacgtgggggaaccacggggaaccctgggtaccaccgtctccctcg

SEQ ID NO: 397657 - DNA, 710 bp, Homo sapiens
  misc_feature: GZ8MTXP02HTMPP.39.85.H08.1.454.CMB.2.raw
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctctgtagacgcctcgtgtacttcctacttgaactaagtgtcgccagtcgaccgtcgggtcccgaccgaggactccggaaggggaacggggcgtagggaggtgggtctacgtagtttagttaggtggttaggtggtagtagcacgagtagtacgacagtaccgtcccggtaggacgggtccgtacactactctccgagacgaactaacttaccaacgacgccgaacgtcgttagttacttcgactaactagtacgaaacacgccgtagacgaccggaccgggacggaaccgaccggtacctaagttaacttaagttagttacggtacggtaaccgtttaaaccgttttccgttttaagtaccgttttacggttttaactttacccgttacccccgttaaggttacccggaacccgtacggggtacccggggtacccggtaaccggggtaaccccgtcgggttacccgacccggttcccttcccgtaccgtaccccg

SEQ ID NO: 397658 - DNA, 557 bp, Homo sapiens
  misc_feature: GZ8MTXP02GT5ZE.39.85.H08.1.454.CMB.2.raw
  modified_base (269)..(269): a, c, t, g, unknown or other
  modified_base (390)..(390): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccncaggctccgaggggaggggctggagtgggtctcgagtttataggtggtagtggtagtagcagagattacgcagaccctccgtgaacgggccgttcaccgatctccagacgacattcaaacngcacgtctgtatttgcacatgaacagcctagagacgcgaggacacggcctagtatattattgagtcgtaaactttctttgacttaggttacttacttccccgtagttcgaacctacggtcggggaaccgaacggggtaaccctcggtccgtacccgtcctccgtccg

SEQ ID NO: 397659 - DNA, 586 bp, Homo sapiens
  misc_feature: GZ8MTXP02GQQED.39.85.H08.1.454.CMB.2.raw
  modified_base (476)..(476): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacaagtgtgccatgacctgggtccgccaggatccgaggggaagggctggagtgggtctcgagtttatagtggtagtggtagtagcacagtattacgcagactccccgtaggaacgggtccgtacaccatctccagacgactaacgttcccaaactgccaacgtcttaggttatttcgctaacatacgaaactgcctaggagacggccgaggacacggcattagtacttatgngacgtaactttcgtttgactttggttaactttactaccccgttagcgtaccgaccgttcggggaccaacggggtacccttacgggtaccacccgtcgttccctcacccgg

SEQ ID NO: 397660 - DNA, 546 bp, Homo sapiens
  misc_feature: GZ8MTXP02F1GLW.39.85.H08.1.454.CMB.2.raw
  modified_base (267)..(267): a, c, t, g, unknown or other
  modified_base (333)..(333): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctggtccncaggctccgagggagggctggagtgggtctcagttatagtggtagtggtagtagcacagattacgnagactcccgtgacggcgtacacatctccagagactaattccaaacagcacgtctgtatttgcacatagaacagtccagagacgaccggagacacggccatatattattagtcgtacgtaaacttccgttttagacttaggtttattactccccgttagtcgacctacgtcgggaccgaacgggtaaccctggtccaccggtctccctgacccg

SEQ ID NO: 397661 - DNA, 544 bp, Homo sapiens
  misc_feature: GZ8MTXP02IZ1HC.39.85.H08.1.454.CMB.2.raw
  modified_base (301)..(301): a, c, t, g, unknown or other
  modified_base (360)..(360): a, c, t, g, unknown or other
  modified_base (385)..(385): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccaggggaagggctggagtgggtcncagttattagtggtagtggtagtagcacagattacgcagacctccgtgaagggccgttnaccatctccagagacaattccaaanagcacgctgtatttgcacatgaacagcctagagagccgaggacacgggccatatattattgtagcgaaactttctttgacttggttattattacccctagtcgaaccgtacgtacgggggtcccacggggaaccctcgggtaccacccgtctccctccg

SEQ ID NO: 397662 - DNA, 701 bp, Homo sapiens
  misc_feature: GZ8MTXP02G7A8Q.39.85.H08.1.454.CMB.2.raw
  modified_base (475)..(475): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatcgaccgtgggtccgccaggcctccggaggggaacggggcgtggaggtgggtctacgtagtttagttaggtaggtaggtaggtagtagcaacgtagtagttacgcagaccccgtacggtaggaacgggtccggttacaccgtatcctaccgagaacgaactaactacccaaatacgcctaacgtcttagttaactttggaccctaagatacggaaaccncgtacgtaggaacggaccggaccggaacggaccgaaccggtacttaaattacgttaagtttacgttcggtaacgttaaccgtttaaaccgtttttcgtttacggttaacgtttacggtttaaccttaacccgtcccgttaaaggtacccgtaacccggtacgggtaccggggaacccgtaacccggtacccgttacggtacccctaccgttaccctacccgtaccg

SEQ ID NO: 397663 - DNA, 820 bp, Homo sapiens
  misc_feature: GZ8MTXP02HK50I.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgacaagtgtgccatgaccgtggtcccgccaggctccgaggggaagggcgtggagtgggtctcgagttattagtggtagtggtagtagcacagattacgcagaccctccgtagacgggccggttcaccgtatcctccagagacctaacgttaccaaacgcgaccaacgtccttaggttaattttcggacctaaacctaagttacggtaaaacccagggacccccttaggggaaacgaaccggggaacccccgggaaacggggaaaccccggaaacccggggtaccccgtaaagtttaaacgtttaaacttttaaacggttttggggttaaacggttaaccccggtttaaaaaccttttttccccgttttttagggttaacccgttttaggggtttttaaaaccttttaacccgtttaacccccccgtttaaagggttacccgttaaaccccggtaaacccgggtttccggggggggtaaacccccgttaaaccggggggggtaaaacccccccttttcggggggttaaccccccttaaccccggggtttaccccctttcccccggtttaaaccccgg

SEQ ID NO: 397664 - DNA, 590 bp, Homo sapiens
  misc_feature: GZ8MTXP02FID5E.39.85.H08.1.454.CMB.2.raw
  modified_base (347)..(347): a, c, t, g, unknown or other
  modified_base (382)..(382): a, c, t, g, unknown or other
  modified_base (408)..(408): a, c, t, g, unknown or other
  modified_base (455)..(455): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtcccgccaggctccgaggggaggggctggaggtgggtggaccaaacataaagcaaaggatagggaaagtcggaaagagttancgtggactcgtgtggaggggtccgttcaccatccnccgagagaccaacgcaaagactccgngcatctagacaaatgaaactagtctagagagccggaagacgacggtnttagtttatacgtgcgcggaagaggaaggtcgtaggggtccgtttacgactacggtcgggggaccacgggggtaaccctggggtacccaaccggttctaccgttccaacggtccctacccgaaccgaacccgggg

SEQ ID NO: 397665 - DNA, 557 bp, Homo sapiens
  misc_feature: GZ8MTXP02IG5SN.39.85.H08.1.454.CMB.2.raw
  modified_base (365)..(365): a, c, t, g, unknown or other
  modified_base (368)..(368): a, c, t, g, unknown or other
  modified_base (373)..(373): a, c, t, g, unknown or other
  modified_base (381)..(381): a, c, t, g, unknown or other
  modified_base (444)..(444): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccatgcatgtgacctcagggggtcccctgagactctcctgtgaagcctctggattcacctttgacaagtgtgcccatgacctgggtccgccaggatccgaggggaaggggctggagtgggtctcgagttataggtggtagtggtagtagcacagattacgcagcctcgtgaagggccgtcacntcncaganacatcaangcagctgtattgacacatagaacagcctgagacgccggagaccacggcagtactattatttgngtaccgttaaactttccgtttagacgttaggttattactaccccgttagtacgaaccctacggtacggggccgaacgggtaacccgttggtaccctaccggttcctacctccg

SEQ ID NO: 397666 - DNA, 698 bp, Homo sapiens
  misc_feature: GZ8MTXP02G080K.39.85.H08.1.454.CMB.2.raw
  modified_base (331)..(331): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtcccgcaggctccgagggaaggggctggagtgggtctcgagtttatagtggtagtggtagtagcanagattacgcagacctcgtagacgggccggttcaccgatcctccaagacgactaagtcccaaacacgacacggcttagttatttcgctacatacggaaacacggccctaggaaacgacgggacccggaacgggaaccaaccggggaccctaaagttaagttaatttaagtttggtacggtaacccggttaaaacctttttccccgtttttaaaggtaaccgtttacggggttttaactttaaaccgttccccccgttaaagggttaccggtaacccctaacggggttccggggggaaacccctaacgggggtaaaccccccgtttgggggttacccctaaccccgggtttcccttacccttaacccgg

SEQ ID NO: 397667 - DNA, 787 bp, Homo sapiens
  misc_feature: GZ8MTXP02JTREJ.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgaggggaaggggctggagtgggtctctagttatagtggtagtggtagtagcacgagattacgcgagacccgtccgtaggaaacgggtccggttacaaccgatcctacccgaagaacgaaccaaagttcccaaaacacggaccaaccggtcttagttaaacttttcggaccctaaacctagtacggaaaaaccgtacggtacccgtaagggaaacgggaccggaacccgggaacgggtaaaccgaacccgggtaaccttaaagtttaaacgtttaaagtttaacggtttacgggttaaaccggtttaaaccccgttttaaaaccgtttttcccggttttaacggtttaaccggttttaacggttttaaaccttttaacccggttaacccccggttaaggttacccggtaaacccggttaccggggttaccgggggtaaccccggtaaacccgggggttaaccccgtttacggggtaaccccgttaccccggttcccgttaccccgtaccg

SEQ ID NO: 397668 - DNA, 611 bp, Homo sapiens
  misc_feature: GZ8MTXP02FJP2S.39.85.H08.1.454.CMB.2.raw
  modified_base (393)..(393): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccctgagactctcctgtgaagcctctggattcacctttgacaagtgtgccatgacctgggtcccgccaggctccgaggggaaggggctggaggtgggtctcagtttattagtggtagtggtagtagcacagattacgcagaccctccgtagaggggccgttcaccgatcaccagagacaattccaaacngacacgtcttagtaatttgctacatacgaacacgacctgagacggcccgaaggaccgacgggacccattattattattgtagtaccgtaaaacttttccgttttagtaccgttaggttttaaacttaccgttacccccgttagtacgtacccgtaacgttcgggggaacccgaacggggtaaaccccgtcggtaccgtacccggttctcccgtacccg

SEQ ID NO: 397669 - DNA, 705 bp, Homo sapiens
  misc_feature: GZ8MTXP02HIEJ6.39.85.H08.1.454.CMB.2.raw
  modified_base (271)..(271): a, c, t, g, unknown or other
  modified_base (346)..(346): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaacgcctctggattcacctttgacaagtgtgccatcgacctgggtcccncgaggactccgaaggggagggctgggagtgggtctgtagttattaggtggtagtggtagtagcacagtattacgnagactcccggtaggacgggtccgttacacctatcctccgagtaacgactaaacttcccaaacgacgtaccacgtctacgttatttcgccaacgtatacgaaactacggaccctaggacggacggacccggagggaaccgtaccgggacctaattaaacgttagtttacgttaggttaacgtaccggttaaaacctttttcccgtttttaaggaaccgtttttacgggtttaaactttacccgtaccccgttaaggttacccgtaacccgttaccgggtaccgggggtacccggtaaaccggggtaaaccccggttcggggtaccccctacccggtccctttaccccgtacgtaccccgg

SEQ ID NO: 397670 - DNA, 640 bp, Homo sapiens
  misc_feature: GZ8MTXP02GPUKS.39.85.H08.1.454.CMB.2.raw
  modified_base (421)..(421): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtcccctgagactctcctgtgaagcctctggattcacctttgacaagtgtgccatgacctggtccgccgaggcctccgaggggaaggggcgtggaggtgggtctcgtagttagttaggtggtagtggtagtagcacagatacgcagacctccgtagaacgggccgtcaccatctcagagacattccaacagcacgctgtatttgctacatagaaacncgcctaggaacgacggaccggaggaaccgaccgggacctaattaacgttatttagttggtacgtaccggttaaaacctttccgttttagaccgtttagggttttaaacttaccgttaccccgttaaggtaccggaacccgttaacgggtccgggggtaacccgtaacggggtaacccccggttcgggtacccgtacccggttccttacccgttaccccg

SEQ ID NO: 397671 - DNA, 649 bp, Homo sapiens
  misc_feature: GZ8MTXP02HHDDI.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgacggggtccctgagactctcctgtgaacgcctcgtggtacttctacctttgactaagtgtcgccatcgaccgtcgggtcccgccgaggctccgaggggaaggggctgggaggtgggtctgtagttagttagtggtagtggtagtagcacagtatacgcagaccgtcgtagacgggtccgttacaccatcctaccgaagacgaactaacttccaaacacgcaacgcttagtatttcgacacatacgaaacaggcctaggaacgacggcccggaaggaccaccggacctaagttaacttaagtttagttgtacgtaaccgttaaaactttttccgtttagtactttacggtttaacttaaccgtccccgttaaggtccgaacccgtacggtccggggaacccgtaaacggggtacccctcgggtaccctacccggttccttaccctaccg

SEQ ID NO: 397672 - DNA, 745 bp, Homo sapiens
  misc_feature: GZ8MTXP02GVLVF.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcacctttgactaagtgtgccatcgaccgtcgggtcccgccagggcctccgaggggaaggggcgtggaggtgggtctcgtagttagttaggtggtagtggtagtagcacgagtattacgctacgacccgtccggtaggaacggggtcccggttaccaaccgtactccgtaccaaggaacgtaacctaaacgtttacccaaaacgacgaccaacggtccttaggttaatttcggactaaccaagttacggaaaaccacggtacccgtagggaaaacggccgggacccgggaaacgggaaccgtaaacccgggacccttaaaatttaacgtttaaagtttacggtttagtaacggtaaccggtttaaaacctttttcccgttttaggtaacccttttagggtttaaactttacccgtcccccgttaaaggtcccgtaacccgtacggttacgggggaacccgtaacggggtaacccccttgggtacccctacccggttccctcctaacccg

SEQ ID NO: 397673 - DNA, 546 bp, Homo sapiens
  misc_feature: GZ8MTXP02GB995.39.85.H08.1.454.CMB.2.raw
  modified_base (341)..(341): a, c, t, g, unknown or other
  modified_base (370)..(370): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatcgacctgggtccgccaggctccgaggggaaggggctggagtgggtctcagttattaggtggtagtggtagtagcacagatacgnagacctcgtagaagggccgttcaccatcnccagagacaattcaacagcacgctagtatttgcacatgaaacagcctgaagagccgaaggacaccggaccaatactagttatggtcgacgtaaactttcctttagacttggttattacctccctagtcgaccacgtggggaaccctacgggaaccctcggtaccaccgtctcctcg

SEQ ID NO: 397674 - DNA, 629 bp, Homo sapiens
  misc_feature: GZ8MTXP02GV635.39.85.H08.1.454.CMB.2.raw
  modified_base (366)..(366): a, c, t, g, unknown or other
  modified_base (387)..(387): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaacgcctctggattcaccttgacagtgtgcatgacctggtccgccaggatccgaggggaaggctgggagtgggtctgagttagttagtggtagtggtagtagcacagatacgcagactcccggtagacgggtcgttacacctntctccgagacgacactccaancgcacgtctagtattcgacagatacggaacagtaccagacgacggaccggagtaccgaccgctaaattacttattagttacgtagtaacgttaaacttttccgtttagtaccgtttaggttaactttaccgtaccccgttaagtccgtaaccccgtacgggtaccgggggtaccctaaccgggggtaaacccccttggggttacccctacccggtttaccttaccccgtacgtaacccccgg

SEQ ID NO: 397675 - DNA, 595 bp, Homo sapiens
  misc_feature: GZ8MTXP02IF5LN.39.85.H08.1.454.CMB.2.raw
  modified_base (338)..(338): a, c, t, g, unknown or other
  modified_base (363)..(363): a, c, t, g, unknown or other
  modified_base (391)..(391): a, c, t, g, unknown or other
  modified_base (419)..(419): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcactttgacaagtgtgccatgacctggccgcaggctccgagggaggggctggagtgggtctcgtagtttataggtggtaggtggtagtagcacagatacgnagaccctccgtagagggtccgttanaccatcctcagtacgacaacttccaaanacgcacgctagtattgactacatgaacngcagagacgaccgaggacgacggcaagtattagttaagttgtacggtactaaaaccttttcctttaggtaccttaggttttaaactactttacccccgtaaggttaccgaccgtaacgtcgggggaacccgaaccggggtaaccctcgggtacctacccggtaccttcccgtaccg

SEQ ID NO: 397676 - DNA, 569 bp, Homo sapiens
  misc_feature: GZ8MTXP02I3DCI.39.85.H08.1.454.CMB.2.raw
  modified_base (414)..(414): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccagggaaggggctggagtgggtctcagttattagtggtagtggtagtagcacagattacgcagacctccgtgaagggccggttcaccatctccagagacaattccaaacagcacgtcctttatttgcacatcgaacngcctgagagccgaggacaggccatatacttatgtgacgtaaactttcctttagaccttgggtttattactccccttaaagtcgaccctaacggttcgggggacccaacggggtaaaccccttcggggtacctacccggtccttccgtctaacccg

SEQ ID NO: 397677 - DNA, 606 bp, Homo sapiens
  misc_feature: GZ8MTXP02HX1VK.39.85.H08.1.454.CMB.2.raw
  modified_base (269)..(269): a, c, t, g, unknown or other
  modified_base (403)..(403): a, c, t, g, unknown or other
tcagtcgcactagtcacgaccggtgctcgatttagtatcactcagtcgcgggaggacgctgaccacacggtacgtgctgttgtacctgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcactttgactaagtgtgccatgaccgtggtccnccgaggactccgaaggggaacgggctggagtcgggtctacgtaggtttataggtggtagtggtagtagcagagatacgcagactccccggtagaacggtccgtacacattcgccagacgactaacgttaccaanagcaacgtctagttattcgacactatagaacagtccagacgacgaccgagacgacgtacatatattagtgtacgtacttaaacctttcgtttacgactttacggttaactttaccgtacccttagtccgtaaccgtacggttccggggaccctaaccggggtaacccttcgggacctacccgttacctaccgttaccaacccg

SEQ ID NO: 397678 - DNA, 686 bp, Homo sapiens
  misc_feature: GZ8MTXP02GHBVT.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtcccctgagactctcctgtgaagcctctggattcacctttgactaagtgtgccatgacctgggtccgccaggctccgaggggaaggggctgggagtgggtctcgtagtttattaggtggtaggtggtagtagcacagtattacgcagacccgtcgtaggaacggggtccggttacacccgattccctaccgaagagaacctaaacttacccaaacacgaccacgtcttagttatttcgcaactagtacgaaaccaggccctaggaaggacggaccggaacggaaccgaccgggacctaagttaattaacgtttagttacggtacggtaaaccgtttaaaccgttttcccgttttaggtaacgtttagggttttaaacctttaccgttacccccgttaggtaccgtacccgtaacgggtccgggggtaaccgtaacccggggtaacccgttcgggtaccctaaccggttcctacctacccgg

SEQ ID NO: 397679 - DNA, 603 bp, Homo sapiens
  misc_feature: GZ8MTXP02IKM1W.39.85.H08.1.454.CMB.2.raw
  modified_base (299)..(299): a, c, t, g, unknown or other
  modified_base (326)..(326): a, c, t, g, unknown or other
  modified_base (388)..(388): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgccacctccacgccgtccacgtaccagttgaacttgacctcagggtcttcgtggctcacgtccaccaccacgcatgtgacctcgagggggtccctgagacctctcctgtgaagcctctggattcaccttgacagtgtgccatgacctggtcccgcaggctcgagggaaggctggagtggtctnagtttatagtggtagtggtagtagcanagattacgcaagcctcccgtagaacgggtccttcaccatctccgagagactaacttacccanaacgcacgactggttaatttcgacaactatacgaaacagtccgtagaacgacgacccgggaagaaccgaacggacctaattaactaatttagttagtagaacggtaaagttgggggagggggtaaggtcgggggacttacgtccgttaggtcgttttacgaacgttacggtgggaacccgaggggacgtcccgtaggtccgtaccgtcgtacccg

SEQ ID NO: 397680 - DNA, 762 bp, Homo sapiens
  misc_feature: GZ8MTXP02F6LF6.39.85.H08.1.454.CMB.2.raw
  modified_base (386)..(386): a, c, t, g, unknown or other
  modified_base (520)..(520): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctgacgacctctcctgtgaacgcctcgtggtactttccaccgttttgaactaagttgtcgccctaagtcgacccgtcgggtcccgccgagggcctaccggaagggggaacggggtccgtaggggaggttggggtcctacgtagtttagttaggttaggtagtgggtaagtagcaanaggtacgttacgacgtagaccccgtaccggtaggaaacggggtcccgttacaccctatcccgtaccgaaggaaacgtaacctaacgttaaccgaaacgtacgccgacgtacttaggttactttaggaccctaanacgtaacgaaacgtacgaccgtagggaacggaaccggaccggaacggaaccgaccgggaaccttaagtaaattttagttagttagttacggttaaccttaaaactttttccgttttaagtaacgtttacggttttaacttaaccgttacccgttacggttaccgaaacccgtacggttacgggggaaccccggtaaacgggtaccccgttacgggtccgtaacccgttccgtaccgtacccg

SEQ ID NO: 397681 - DNA, 669 bp, Homo sapiens
  misc_feature: GZ8MTXP02HONGQ.39.85.H08.1.454.CMB.2.raw
  modified_base (333)..(333): a, c, t, g, unknown or other
  modified_base (369)..(369): a, c, t, g, unknown or other
  modified_base (376)..(376): a, c, t, g, unknown or other
  modified_base (408)..(408): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgaagcctctggattcactttgacaagtgtgccatcgaccgtggtcccgcaggcctacgaggggaagggctggagtgggtctcgagttataggtggtagtggtagtagcanagattacgcagacctccgtagaacgggtccggttanaacccgnttcctccgaagacgaactaacgttacccaaanacgaccacggcttagtaatttcgactacagtacgaaaccacgccctaggaaacgacggacccggaagggaccaacgggacctaaattaacgtaatttagttcgtacggaccttaaaaccttttcccgttttagaaaccgtttggttttaaacttacccgtaccccgtttaaggtaccgaaccccgtacgggttacgggggaacccgtaaacggggtaaacccccttcggggtacctaacccccggttcctaccccgtaccg

SEQ ID NO: 397682 - DNA, 713 bp, Homo sapiens
  misc_feature: GZ8MTXP02GYZIW.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgcacctcgaggggtccctgacgactctcctgtgaacgcctctgtacttcacctttgactagtgtcgcctagtcgaccgtcgggtccgccgagggcctaccggaggggaacggggctagggtaggtgggtctcgtagttagttaggtaggtagtaggtacgtaggcaacgtagtaacttacgacgtacggaccccgttccggtaggaacggggtccgttcacctatccgtaccaaggacgaactaactacccgaaactagaccgtaccgtcgttagtagtttacgctaactagttaacggaacaccgttacgcggaaaggccggaccggaacggaccgaccgggtacctaaattacgttaattagttacgacgttaaccggttaaaacttttcgtttacgtactttcggttttaaattacccgttacccgtagttaccggtaacccgtcggggttacggggaacccggtaacggggttaaaccccttcggggtaaccctacccggtttcccgtacctacccgg

SEQ ID NO: 397683 - DNA, 529 bp, Homo sapiens
  misc_feature: GZ8MTXP02HWSVE.39.85.H08.1.454.CMB.2.raw
  modified_base (333)..(333): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggtccgccaggctccgaggggaaggggctgggagtgggtctctagttattaggtggtagtggtagtagcanagatacgcagactcccgtgaacgggccggttcaccatctccagacgacaattaccaacagcacgctagtatttgcacatgaacagcctagagacgcgagacacgcatatattatgtgacgtaacttcttgacttggttattactccctagtcgacacgtcggggccaaggaccctggtccaccgtctcctacaccg

SEQ ID NO: 397684 - DNA, 575 bp, Homo sapiens
  misc_feature: GZ8MTXP02JSA0B.39.85.H08.1.454.CMB.2.raw
  modified_base (271)..(271): a, c, t, g, unknown or other
  modified_base (330)..(330): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgaagcctctggattcacctttgacaagtgtagccatgacctgggtccnccaggctccgaggggagggctggagtgggtctctagttatagtgtagtggtagtagcanagattacgcagcctccgtagaaggggtccggttcaccatccgtccaaggacgactaatccaaactagcaacgtctgttaactttgaccacgtatacgaacacgcctagaacgacgccggacggacacggcctaatattactagttagtcggacttaaacgtttcttgtacttaggtttacttacgtacccctaagtcgaaaccgtgtcggggaaccacgggtacctcggcctaccgtctctaccg

SEQ ID NO: 397685 - DNA, 764 bp, Homo sapiens
  misc_feature: GZ8MTXP02I6E3T.39.85.H08.1.454.CMB.2.raw
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtcccctgagactctcctgtgaagcctctggattcacctttgacaagtgtgccatgaccgtgggtcccgccaggcctccgaggggaaggggctggagtgggtctcgtagttagttaggtggtagtggtagtagcacagtattacgcgagacctccggtagaacggggtcccggttacaacccgtactccgtaccaggaacgaacctaattacccgaaaactaggacccgaaaccgtccttagggttaacttttcggacccttaaaaccgagttaacgggaaaaaccctccgggtacccgttagggaaaccggaaaccggggccccgggaaacgggttaacccgaacccggggtaacccttaaagttaactttaaacgttttagtttacgggtacgttaaccgtttaaaaccgttttcccgtttttaacgggtacttttacgggtttaaactttaaccccgttacccccgttagttacccgaaccccgtaggttacccgggggaacccgaaccgggttaaccccgttcggggtaccctacccgttccgtttacccacccgg

SEQ ID NO: 397686 - DNA, 554 bp, Homo sapiens
  misc_feature: GZ8MTXP02H1WIY.39.85.H08.1.454.CMB.2.raw
  modified_base (455)..(455): a, c, t, g, unknown or other
  modified_base (474)..(474): a, c, t, g, unknown or other
tcagtcgcactagtcacgaccggtgctcgatttagtatcactcagtcgcggtgaggacgctgaccacacggtacgtgctgttgtactgctcctccccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggattcacctttgacaagtgtgccatgacctgggccgcaggctccaggggaaggggctgggagtgggtctcgtagttattaggtggtagtggtagtagcaacagattacgcagaccctccggtagaaggggccggttcacctatctaccagacgacaactccaaacagcacgctgtattgctacatgaacagcctgagagccgagacacggcatatattatgngacgtaaactttcgtttanacgtagttataccgtaccctagttacgacctacgtcgggggaaccaacgggtaacccctggtaccaccgttcctctaccg

SEQ ID NO: 397687 - DNA, 695 bp, Homo sapiens
  misc_feature: GZ8MTXP02JK60E.39.85.H08.1.454.CMB.2.raw
  modified_base (231)..(231): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctcnggattcacctttgacaagtgtgccatgacctgggtccgccaggctccgagggaaggggctgggagtgggtctcgtagtttagttaggtggtagtggtagtagcacagtattacgcagaccctccggtagaacggggtccggttcacccatcctaccgagacgactaaagttacccaaacaggaccaacgtcctagttacttttcgacaaactatacggaaactagacccgtagaaacggaccggaccggaacggacccgaacggggtccctaaagttattaacgttaatttggactaccggttaaaacctttccgttttaggtaaaccgtttgggttttaaacctttaaccgtacccccgtttaaggtaccgtaacccgtaccggttacgggggaacccgtaaaccggggggttaaaacccctcggggttacccctaacccggtttccccttaccccgtacccg

SEQ ID NO: 397688 - DNA, 612 bp, Homo sapiens
  misc_feature: GZ8MTXP02F3C29.39.85.H08.1.454.CMB.2.raw
  modified_base (232)..(232): a, c, t, g, unknown or other
  modified_base (270)..(270): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtgaagcctntgattcacctttgactaagtgtgccatgacctggtccncgaggcctccgaggggaagggcgtaggagtgggtctcgtagttattagtggtagtggtagtagacacgagtacttacgacgacgtaccccgtaccggtaggaacggggtcccgttacacccgtactcgtccgaagtacgaactaacgtaccaaacgacgacacgtcgtagttagttcgactacatacgaactcgaccgtgagaccgcggaacgacgaccgctaatagtattacgtgtactaacgtaacgtttcttacggtacttagttacttaccgtacccgttagtaccgacgtacgggtcggaaccgtaccgggtacctcggcctaccgtcctacgtccg

SEQ ID NO: 397689 - DNA, 672 bp, Homo sapiens
  misc_feature: GZ8MTXP02IP8OJ.39.85.H08.1.454.CMB.2.raw
  modified_base (231)..(231): a, c, t, g, unknown or other
  modified_base (399)..(399): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtcgacctcgaggggtccctgagctctctgtgacgcctntggtacttctacctttgaacagttgtcgcctatcggtaccgtcgggtcccgccgaggccgtaccggaggggaacgggcgtagggaggtggtctcgtagtttagtaggtggtaggtggtagtagcagagtactacgctacgaccgtccgtaggacggtccgttacactntctaccaagacgactaacctacaaatcgacctaacgtctttagttacgttacgacctataacgtacgaaccgtacggaccgtaggacggaacggccggaaacggtaccggaaccgtactaagttaactttagttaacgttacggtacgttaacccggttaaactttcgtttaacgtacgtttacggtttaacttacccgtaccgtacgtaccgtaaccgtacgggtaccgggaaccgtaacggtccgtacgacccgtcctaccgttccacccg

SEQ ID NO: 397690 - DNA, 808 bp, Homo sapiens
  misc_feature: GZ8MTXP02GW6SI.39.85.H08.1.454.CMB.2.raw
  modified_base (287)..(287): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctgacgacctctcctgtagaacgtcctctggtacttctacctttgaactagtgtcgcctagtcgaccgtcgggtcccnccgaggcctaccggaaggggaaggcgtgggaggtcggtctcgtagtttaagttaggtaggttaggtggtaggtagaccgagtaagtattaaccgcaacggtaccgtcccggtagggaaccggggtccccggttaccaaccgtacttaccgtccgaaacgaaacgtaaacctaaaccttacccgaaacgacgtaccgaccgttcttacggttactttacggacctaaacgtacgtaacggaaaccgtaacgtacccgtaaggggacggaaccgggacccggaaacgggaacccgaccgaccgtaagttaaatagtttacgtaggtaggtaacggtaaagggttgggggtaggggggtacggttaccgggggtaaccttaccgggtttccggttcggggttaccggtttttaccggaaaccgggttacccggggttccggggggaaacccggttacgggggtaaccccggttaccccgggttcgggttaacccccgtacccgggtttccccggttaacccccg

SEQ ID NO: 397691 - DNA, 587 bp, Homo sapiens
  misc_feature: GZ8MTXP02FPI0E.39.85.H08.1.454.CMB.2.raw
  modified_base (291)..(291): a, c, t, g, unknown or other
  modified_base (302)..(302): a, c, t, g, unknown or other
  modified_base (371)..(371): a, c, t, g, unknown or other
  modified_base (391)..(391): a, c, t, g, unknown or other
  modified_base (393)..(393): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgcgacctcacggggtccctgagacctctcctgtgaagcctctggattcacctttgacaagtgtgccatgaccgtgggtccgcaggctcgagggagggcgnggagtggtctntagttagttagtggtagtggtaagtagcacagattacgcagaccctcgtggacggtccgttcaccatcnccgagacgacaattaccaanancagctgttatttgcacatagaacagacctgaagacggaccgaggaccaccgggacctaatacttattagttgtacggaccgttaaaacctttctttagtacgtttaggtttaacttaccgtcccgtagtaccgaaccgtacggtacggggaaccgaacggggtacccctggtaccctaccgtacctccctaccg

SEQ ID NO: 397692 - DNA, 714 bp, Homo sapiens
  misc_feature: GZ8MTXP02HB5I5.39.85.H08.1.454.CMB.2.raw
  modified_base (518)..(518): a, c, t, g, unknown or other
  modified_base (695)..(695): a, c, t, g, unknown or other
tcagtcgcactagtcacgaccggtgctcgatttagtatcactcagtcgcggtgaggacactgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgaggggtccctgacgacctctcctgtagaacgtcctcgtggtacttctacttgactagtcgtcgccagtcgaccgtggtcccgccgaggccgtaccggaagggggaacggggcgtagggaggttcggggtacctagttaggtttagtttaggtaggggtaggttcggtaagttaggacaacgaagtacgttacggacaacggtaccccggtcggtacggtaaacggggtccccgttacaacccgtacgtcctacgtaaacgaacgtaacctaaacttaccgaaacgacgacctacggtacttagttacgttcacctanactaacgaactaggccgaggacggaccggtaccggaagggaccaacggtactaattactatttagtcgtacgtaaccgttacttttcgttacgtaacgttttgttaacctaccgtcccgttaggaccgtaaccgcgggttaccgggaacgtaccggggtacccttaggggtaccccncggttccctaccgtacccg

SEQ ID NO: 397693 - DNA, 620 bp, Homo sapiens
  misc_feature: GZ8MTXP02G9PA2.39.85.H08.1.454.CMB.2.raw
  modified_base (353)..(353): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgaagcctctggtattcacctttgacaagtgtgccatgaccctgggtcccgccgaggactccgagggaaggggctggaggtgggtctcgagtttagtgtggtagtggtagtagcacagattacgcagctccgngacggcgtcacatctcagagactaaacgttcaacgacgtcgacgtcgttagttactttcggctaacgtactaacgacgtaacgcctaggacgaacggccgacggaaccgacggacctaagtaattattaagttgtacgtcgtaaaacctttcgtttagtacgtttaggttaactttactacccccgttaagtaccgtaccgacgtccggggtaaccgtaacgggtaacccgtcgggtacctacccgtacctacccgtaccgtacccg

SEQ ID NO: 397694 - DNA, 733 bp, Homo sapiens
  misc_feature: GZ8MTXP02HG4PM.39.85.H08.1.454.CMB.2.raw
  modified_base (423)..(423): a, c, t, g, unknown or other
  modified_base (519)..(519): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgacgactctcctgtgaacgcctctggattccacctttgaactagtgtcgacagtcgaccgtcggccgcaggcctaccgaggggacgggcgtcggaggtcggtcctacgtagtttagttaggtggttaggtcggtaagtacgacgtactaagtacgttaaccggcgacgtacccgttccgggtagggaaacggggtccccgttacaaaccctntcccgtaccgaagaacgtaacctaacgtaccccaaagacggtacaccgtctagttacgtttcactaactacgtacgaactgtacccaggaaaccgngaccggtaagaacccgaggtaccctaagttaattagtttgtacggttacgtaaacggtttaaaccttttcctttaggtaaccggtttacggttttactttaaccccggttacccttaaaggtcccgaaccggttaaccgggtccgggggaacccgtaaaccgggggtacccgttaccgggtaaccctaccccggtacctttccccgtaaacccg

SEQ ID NO: 397695 - DNA, 734 bp, Homo sapiens
  misc_feature: GZ8MTXP02GN58F.39.85.H08.1.454.CMB.2.raw
  modified_base (233)..(233): a, c, t, g, unknown or other
  modified_base (272)..(272): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcaccgtccaccaccacgcatgtgacctcgaggggtcccctgacgactctcctgtgagcctntggattcactttgacaagtgtgccatcgacctgggtccncaggctccgaggggaagggctggaggtgggtctcgtagttagttagtggtagtggtagtagcaacgagtattacgctacgacccgtccggtaggacggggtccggttaccaaccgtactccgtaccgaaggtaacgaacctaaacttacccaaacgacgccaaacgtccgttagttaactttcggaacctaactacggtacgaaacccgtacgacccgttagggaacgacggaacccggaagggtaaacccgacccgggtaccaaatttaagttaaagtttagttagggttaccgtaaaccgttaaaacccgtttttcgtttaacggtaacgtttacgggttttaaacttaccttacccccggttagtaccgtaaccccggtaacgggtccgggggaaacccgtaacgggggtaaaccccctttcgggaccccgtaacccggttcccttacccgtaacccgg

SEQ ID NO: 397696 - DNA, 643 bp, Homo sapiens
  misc_feature: GZ8MTXP02FNYWH.39.85.H08.1.454.CMB.2.raw
  modified_base (232)..(232): a, c, t, g, unknown or other
  modified_base (251)..(251): a, c, t, g, unknown or other
  modified_base (415)..(415): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgaagcctntggattcaccttgacagtntgcatgaccgtggccgcaggctcgaggggaaggggctggagtggtctgagtttatagtggtagtggtagtgcatagatacgcagacctcgtaggaacggccggttcaccatcctccgaagagaaccaattacaaacacggctaacgcttagtactttgactaanctagaaactcacgtgaaggacggaccggaggtaacccacgggtacctaatacgttatttagtagtcgtaacgttaaactttccggttttaagactttacgggtttaaatttaccccgttaccccgttaaggtaccgtaaaccggttacgggaccggggtaaccggtaaaacccgggggtaaaccccttgggggtaaccccttaacccggtcccgtttaccgtaacccg

SEQ ID NO: 397697 - DNA, 581 bp, Homo sapiens
  misc_feature: GZ8MTXP02FKTBI.39.85.H08.1.454.CMB.2.raw
  modified_base (270)..(270): a, c, t, g, unknown or other
  modified_base (292)..(292): a, c, t, g, unknown or other
  modified_base (406)..(406): a, c, t, g, unknown or other
  modified_base (435)..(435): a, c, t, g, unknown or other
  modified_base (442)..(442): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgcgacctcaggggtccctgagactctcctgtgaagcctctggattctacctttgacaagtgtgccatgacctgggtccncaggctccgaggggaagggcgnggagtgggtctcgtagtttataggtggtagtggtagtagcacagattacgacagacctccggtggaaacgggccggttcaactatcctccaaggaacgacaacttaccgaaacngaccacgctgttaatttgcaacatagaanacaccgngagacgaccgagacgacgaccatataattattgtgtactaactttactttacgtacgttagttacgtttacttacctacgtacgtaccgtacgtacgggaaccgtacggaaccgtacggtactaccgtcctccgtcccg

SEQ ID NO: 397698 - DNA, 754 bp, Homo sapiens
  misc_feature: GZ8MTXP02I50LT.39.85.H08.1.454.CMB.2.raw
  modified_base (232)..(232): a, c, t, g, unknown or other
  modified_base (270)..(270): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctccgtgtgaacgcctntggattcactttgacaagtgtgccatcgacctggtccnccaggctccgagggaaggggctggagtgggtctcgagttagtagtggtaggtggtagtagcacagtattaccgcagacccgtcggtaggaacggggtcccggttacacccatcctaccgagacgaacaaacttcccgaaacacggtaccacggtaccttgtaactttcggaactacacgttaacgaaaccgacgtacccgtaggaaacgggaaccggaccgggaacgggaacccgaccggggacccttaaagttaactttaaacgtttaacgtttaggggtacgtaaaccggtttaaaacctttttcccgtttttacggtaaccgtttaaccggggtttaaattttaaaccccgttaacccccgttttaaggtaacccggtaacccggtacccggttagggggaaccccgttaaccggggggtaaaaccccccttgggggttaaccccccaaccccgggtttcccttaaacccccgttacccgg

SEQ ID NO: 397699 - DNA, 667 bp, Homo sapiens
  misc_feature: GZ8MTXP02HMEX7.39.85.H08.1.454.CMB.2.raw
  modified_base (489)..(489): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtgaagcctctggattctacctttgactaagtgtcgccatggaccgtgggtccgccgacggctaccgaggggaaggggctgggaggtgggtctacgtagtttataggtggttaggtggtaggtagtcacagtattacgctagacccgtccgggtaggaacggggtcccgtttacaacccgtattccgtccgaaagacgtaacctaaacttcccaaagcgaccaacgtcgttagttaacgtttgactaacgtatacgaacacgtacgngaacggccggaccgggaacggtaccgacgggtacctaaatatatttaagttgtacgaccttaaacttttcgtttagtacgtttggtttaacttacctaccccgttaggtccgaacctacggggtaccggggaacccgtaacggggtacccgttacggtacaccccgttctacctcccg

SEQ ID NO: 397700 - DNA, 635 bp, Homo sapiens
  misc_feature: GZ8MTXP02F1ZPR.39.85.H08.1.454.CMB.2.raw
  modified_base (300)..(300): a, c, t, g, unknown or other
  modified_base (401)..(401): a, c, t, g, unknown or other
  modified_base (438)..(438): a, c, t, g, unknown or other
tcagtcgcactagtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgagggtccctgagactctcctgtgaagcctctggattctacctttgactaagtgtcgccatgaccgtggtccgcaggctcgaggggagggctgggagtggtntacgtagttataggtggtagtggtagtagacacgagtatacgcgacgtacgtcccgtagaacgggtcgtacgtaccactctcgacagacactactacaacncactacgtcttatagttcgataacgataacgaaacgngtaccgaggagaccggacggacgacgaaccgtactaagttaattagtttagtcggtaactaaccgtttaaactttttcgtagttaacgtttcgtttacctttacctaccgttacggtacgaacccggtcgggtaaccgggaacccggttaaacccgggtaccgtttaccacccggttaccctcctacccgtaacccg

SEQ ID NO: 397701 - DNA, 759 bp, Homo sapiens
  misc_feature: GZ8MTXP02H9UEY.39.85.H08.1.454.CMB.2.raw
  modified_base (230)..(230): a, c, t, g, unknown or other
tcagtcgcactagtcacgaccggtgctcgatttagtatcactcagtcgcggtgaggacgctgaccacacggtacgtgctgttgtactgctcctcccgcggctttgtcttggcattatgcaccctccacgccgtccacgtaccagttgaacttgacctcagggtcttcgtggctcacgtccacccaccagcatgtgacctcgaggggtcccctgacgactctcctgtgaancctctggtattctactttgactaagtgtcgccatcggaccgtgggtcccgaccgacggccgtcggaagggggaggggtcgtagggtacggttcgggtacgtcgttaaggtttaagttaggggttaggttagggttagggttaacggtagggacctaacgaaaggttaaacgttaccggaccgacggtaccccgtaccggttaggggtaaaaccggggtcccggtttacaacccgtaactccgtacccgaagaaacgtaaacctaaattacccgaaaacacgacgaacgtccttagttaatttacggactaaacctataaccggaaacacgttaccgtaaggacgggtaccgaccgggtaaaacgggccaaacgtaaccaatttaagttaaacgtttggtagtaccgtaaccgtttaaacttttacgtttacgaacgtttacggttttattaccgtacccgtaggtccgaacctcggtacggggaaccgtaacgggaccccgttggtaaccctccggtttcaccgtaccg

SEQ ID NO: 397702 - DNA, 529 bp, Homo sapiens
  misc_feature: GZ8MTXP01BVFZV.3.37.D04.1.454.CMB.2.raw
  modified_base (241)..(241): a, c, t, g, unknown or other
  modified_base (415)..(415): a, c, t, g, unknown or other
  modified_base (509)..(509): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctcgtgtctgggtctcctggacagtcgatcaccatctcctgcactggaaccagcagtgacgttgganatataattatgtctctggtaccaacactccagacaaacgccccaaactgatgatttatgatgtacaataatcggccctcgagggtttctaatcgtcttcctctgctccaagtctgcaacacggccctccctgaccatctctggctcgagggtgaggacgagggctgacttatangtcaggctcaattacaagcacgcaccactcacgtcttacggaactggacgtaaacgttccgacgtcgttacggcacgcccaacggcccaacccncttacgtccttaacgttccc

SEQ ID NO: 397703 - DNA, 583 bp, Homo sapiens
  misc_feature: GZ8MTXP01EOHNV.3.37.D04.1.454.CMB.2.raw
  modified_base (244)..(244): a, c, t, g, unknown or other
tcagagacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtanatataatatgtctctgtacaacaactccagcaaagccccaaactgatgatttatgatgtacaataatcgcctgtagggtttctaatcgtcttctctgctacagtctgcaacacggccctcctcgaccatctctcgggctcgagggtgaggacgaggctagattatactgcagtctctaatttacgaagcagaccaaccactcgtacggttccttacggtaacgtacgggttaacgttaaacgggttcctaaccggttccgttacgggttcccaacgaaccccggaaaaccgggcccctaaaacccccggacgttcgtaacccgttaacccgtttccccg

SEQ ID NO: 397704 - DNA, 569 bp, Homo sapiens
  misc_feature: GZ8MTXP01C378Q.3.37.D04.1.454.CMB.2.raw
  modified_base (243)..(243): a, c, t, g, unknown or other
  modified_base (351)..(351): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtanatataattatgtctctggtaccaacaactcccagcaaacgcccccaaatgatgatttatgatgtacaaataatcggccctcgtaggggtttctaaatcgactttcctntggctccaagtctggctaaacgacgccctccctgacccatcctcttcggctccgagggtgaggacgaggctgtattagtactgcaggcttatatttaacaagcacgcaccactcaacggtccttacggaaacgtgggaacctaaacgggttctacccgtcgttacggttccacgaacccgaacggcccaaacccctacgttactccgaacctttcccg

SEQ ID NO: 397705 - DNA, 530 bp, Homo sapiens
  misc_feature: GZ8MTXP01A90PG.3.37.D04.1.454.CMB.2.raw
  modified_base (242)..(242): a, c, t, g, unknown or other
  modified_base (324)..(324): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatataattatgtctctggtaccaacaactcccaggcaaagcccccaaactgatgatttatgatgtacaaataatcggccctntaggggtttcaatcgcttctctgctcaagtctggcaacacgcctcctgaccatctctggctccgagggtgaggacgaggctgattatacgtgcaggctctatttaaccgaagcagccaaccgactcgtaggttctgggaactgggactaaaggttccacgtccttagttcacgcccaaggcccaacccgcttcgtccaacgttccc

SEQ ID NO: 397706 - DNA, 718 bp, Homo sapiens
  misc_feature: GZ8MTXP01CWX3Q.3.37.D04.1.454.CMB.2.raw
  modified_base (242)..(242): a, c, t, g, unknown or other
  modified_base (302)..(302): a, c, t, g, unknown or other
  modified_base (356)..(356): a, c, t, g, unknown or other
  modified_base (364)..(364): a, c, t, g, unknown or other
tcagagacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttganatataattatgtctctgtaccaacactccagacaaacgcccccaaactgatagtatttangatgtacaatatccgccctcgtagggtttctaatcgcttcctctgctcaagtcnggcaaacncggccctcccgtagacccatcctcgtcgggccttaccggaggggtcgaagggaacgtacggggtctaggtaatttaacgttaaccgtgtacccgtaaggggtacccttaacgttaaacttttaaaccgaaacgtccgtaaacggacccgtaaaccccgtaacttaccgtaacggggttcccgtttaaaaccgggggtaaccgtttaacgggggttaaacccgttaaaacggggttcccgtaaaaccccgggttccgttaaacgggttacccttaacccgggaacccccgaaaaccggggttaaccccccaaacccctaccgttaccggttaacccttaacccggttttcccccg

SEQ ID NO: 397707 - DNA, 522 bp, Homo sapiens
  misc_feature: GZ8MTXP01BXM9Z.3.37.D04.1.454.CMB.2.raw
  modified_base (229)..(229): a, c, t, g, unknown or other
  modified_base (244)..(244): a, c, t, g, unknown or other
  modified_base (412)..(412): a, c, t, g, unknown or other
  modified_base (507)..(507): a, c, t, g, unknown or other
tcagagacgcactccacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccngcagtgacgttgtanatatatatgtctctgtacaacactccagcaagccccaaactgatgatttatgatgtacaatatcggcctcgtaggggtttctaatcgtacttcctctggctacaagtctgcacacggccctccctagaccatctcgtcggctccgagggtcgaggacgagtctgattntaactgcaggctatacttacaagcacgcaccactcgagtcctggaacgtcgggactaaggcaccgtcttaggttcacgtccgaacgccaacccgnttcgtcaacttcccg

SEQ ID NO: 397708 - DNA, 576 bp, Homo sapiens
  misc_feature: GZ8MTXP01D9480.3.37.D04.1.454.CMB.2.raw
  modified_base (242)..(242): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatataattatgtctctgtacaacaactccagcaaagcccccaaactgatgatttatgaggtacacaaagcggccctcaggggtccctgatcgcttcctctgcctcaagtctggcaacacggccctccctgaccgtctctcgggctccagcctgagatgaggctgattattactgcagctcatatgcaggacatacaactacgttggttttcgggcgggaaggggacccaaaggtccgttacgggttaaccccggttccgttaaacggggtcccgaaaacggcccccgtaaacgggggccccttaccgggtccccccccgttcggggtttccccc

SEQ ID NO: 397709 - DNA, 592 bp, Homo sapiens
  misc_feature: GZ8MTXP01EEHQL.3.37.D04.1.454.CMB.2.raw
  modified_base (229)..(229): a, c, t, g, unknown or other
  modified_base (244)..(244): a, c, t, g, unknown or other
  modified_base (300)..(300): a, c, t, g, unknown or other
  modified_base (496)..(496): a, c, t, g, unknown or other
tcagagacgcactccacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccngcagtgacgttgganatataatatgtctctgtaccaacactccagacaaacgcccccaaatgatgatttangatgtacaaataactccggcctcgtagggtttactaatcgtcttcctcgtggctccaagtctaggaaccaaacaccgggccctccccgtagtacccctatcctcgtcgggccttacccggagggtcgaagggacggaggtcgttagtaattacttacgtgaccagggtcttactatttaaccaagcacgcaacccnctcgagtccgtaggaacgtagggactaacggttcaaccgttccgagggttcacggaacccaacggaacccaacccacgttctccgttaacttcccg

SEQ ID NO: 397710 - DNA, 563 bp, Homo sapiens
  misc_feature: GZ8MTXP01CPLNH.3.37.D04.1.454.CMB.2.raw
  modified_base (241)..(241): a, c, t, g, unknown or other
  modified_base (299)..(299): a, c, t, g, unknown or other
  modified_base (360)..(360): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatataatatgtctctgtaccaacaactcccaggcaaagcccccaaactgatgatttangatgtacaataatcggccctgagggtttctaatcgcttcctctggctcaagtctggcaacncgccctcctgacatctctgggctcgagggtgaggacgagggctagattattacgtgccaggtctagtactttaacaaagcaagccaacccactcgacggttcttcgggaaacttcggggaactaaacggttccgaacccgttcttaacgggttccaacgccccaaacggccccaaaacccgcgttcgtaaccgaaccgttccg

SEQ ID NO: 397711 - DNA, 526 bp, Homo sapiens
  misc_feature: GZ8MTXP01ASL4R.3.37.D04.1.454.CMB.2.raw
  modified_base (242)..(242): a, c, t, g, unknown or other
  modified_base (402)..(402): a, c, t, g, unknown or other
  modified_base (419)..(419): a, c, t, g, unknown or other
  modified_base (520)..(520): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatataattatgtctctggtacaacactccaggcaaacgcccccaaactgatgatttatgatgtacaataactcgcctcgagggtttctaaatcgcttcctctggctccaagtctggcacacggcctcctgacactctctggctccgagggtcgaggacgngctgattagtactgacnggctactatttacaaagcagaccaccgactcgaggtcttacgggaactgggactaggttcaaccgtcgttagcacgcccacggcctaacccgattcgtccncgtccc

SEQ ID NO: 397712 - DNA, 676 bp, Homo sapiens
  misc_feature: GZ8MTXP01EFSB4.3.37.D04.1.454.CMB.2.raw
  modified_base (229)..(229): a, c, t, g, unknown or other
tcagagacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctcgtgtctgggtctcctggacagtcgatcaccatcctcctgcacgtggaaccngcagtgagttgatatataatatgtctctagtacaacactccaggacaaacgcccccaaactgatgtatttatgatgtacaatacgtccgtcctcgtagggtttctaagtcgtactttccctcgtggtacctccgtaagtccgtaggaacctaaaccgtacccgggtcccctccctacggaccctactcctccgtcgggtcctacgggaggggtagagggaacggtacggtcttaggtaattacgttaacgtgacgtaggggtccttactaaagtttaaccgaaacgaccgtacggacctaaacccgtactccgtacggtttaccgttccggaaaacgttcgggttaactaaaccggttccgtacccggtaaccgttacgggttaccgaccggaaccccgaaacgggtaacccccaaacccgtacgttcgtccgttaacctttccccg

SEQ ID NO: 397713 - DNA, 677 bp, Homo sapiens
  misc_feature: GZ8MTXP01CY554.3.37.D04.1.454.CMB.2.raw
  modified_base (240)..(240): a, c, t, g, unknown or other
  modified_base (298)..(298): a, c, t, g, unknown or other
tcagagacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgcctgagtcagcctgcctcgtgtctgggtctcgtggacagtcgatcacatctcctgcactggaaccagcagtgacgttgganatataattatgtctctgtacaacactccagacaaacgccccaaactgatagtatttangatagtacaaataactccggtacctcgtaggggtttctaagtcgtcttcctctggctaccgaagtctggcaaacgaccggcccttcccgtacgaccatctcgtcggtctccggagggtgaagggtacggagggtctaggtatttataccgtagtactacgggtccttacgtaaactttaaccgaaaggtaccaaaccgcccgtaaaccctacgtaccgtaaaccgggttcgttaccggggtaaaaccgttcggggaaaccgttaaacgggttaccgtaaccccggttcccggttaaaccggggttccaaaccggaacccccgaaacgggtaaccccaaacccccgtacgttacccggtaaccgttaaccgtttccccgg

SEQ ID NO: 397714 - DNA, 588 bp, Homo sapiens
  misc_feature: GZ8MTXP01ES536.3.37.D04.1.454.CMB.2.raw
  modified_base (244)..(244): a, c, t, g, unknown or other
  modified_base (441)..(441): a, c, t, g, unknown or other
tcagagacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtanatataattatgtctcctggtaccaacaactcccaggacaaacgcccccaaatgatgaatttatgatgtacaaattaatccggcccttcgtagggggtttactaatccgtcttccctctggctccaagtctggcaacacgggccctccctgaccatctcgtgggcctcgagggtgaggacgagggctagattattacngcagggtcttctaatttaacaagcaacgaccaccactcgacggtccttacgggaaacttgggacgtaaacggttccgaccggtaccgttaggttccacgccccaaacggcccaaaccccgtacgttcgtccttaaccgtttaacccg

SEQ ID NO: 397715 - DNA, 509 bp, Homo sapiens
  misc_feature: GZ8MTXP02J2MB0.3.37.D04.1.454.CMB.2.raw
  modified_base (421)..(421): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccagtcaaagcccccaaactgatgatttatgatgtcaataatcggcctcaggggtttctaatcgcttctctgctccaagtctggcaacacggcctcctgaccatctctgggctccgagggtgaggacgagctgattatactgcagctnatttacaagcagcaccactcagtcttcggaactgggactaaggtcaccgtcacggtcacgcccaacggccaacccactcgtcactccg

SEQ ID NO: 397716 - DNA, 540 bp, Homo sapiens
  misc_feature: GZ8MTXP02IZJT0.3.37.D04.1.454.CMB.2.raw
  modified_base (242)..(242): a, c, t, g, unknown or other
  modified_base (418)..(418): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatataattatgtctctggtaccaacaactcccaggcaaacgcccccaaactgatgatttatgatgtacaataatcggccctcgtaggggtttctaatcgtacttcctctgctcaagtctgcaacacgcctcctgaccatctctggctccgagggtgaggacgaggctgattatacngcagctctattacaagcagacaccactcgagtcttacggaacgtgggtactaacggtctaccgtccgtacggtcacgaacccgaaacggacccaaaccccgtactacgtacctactttcccg

SEQ ID NO: 397717 - DNA, 576 bp, Homo sapiens
  misc_feature: GZ8MTXP02HBVLR.3.37.D04.1.454.CMB.2.raw
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctctggtaccaacaactccaggcaaacgcccccaaactgatgatttatgatgtacaaataatcggccctcgaggggtttactaatcgtcttcctctggtctcaagtctggcaacacggccctccctcgaccactcctcgtcgggcctccgaggggtcgaggatggaggctagattattactgcagtctacatagtgcgaggcaatactaacctagttcggttttacggacggggtacgggaaccgaaaggccgtacggtacccgtccgttaacggtccgacggacccgaacggtcccgtaccgtcccccgtacggtccccg

SEQ ID NO: 397718 - DNA, 556 bp, Homo sapiens
  misc_feature: GZ8MTXP02HWLCQ.3.37.D04.1.454.CMB.2.raw
  modified_base (294)..(294): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctctgcactggaaccagcagtgacgttggtagatatattatgtctctgtaccaacactccagcaacgccccaaatgatgatttangatgtacaataatccggcctcgtagggttctaatcgcttcctctgctcagtctggcaacacgcctccctgaccatctctcggctcgagggtgaggacgaggctgattattactgcagtcttatactttaacaacgtcgagaccaaccactacgtaacggttccgttacggtaacgtacgggtaactaaacggtccgtaacccgttaccgtacggtaccacgaaccccgaacggaccccaacccgacttcgctaacgttcccg

SEQ ID NO: 397719 - DNA, 535 bp, Homo sapiens
  misc_feature: GZ8MTXP02IOL6B.3.37.D04.1.454.CMB.2.raw
  modified_base (243)..(243): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtanatataattatgtctctggtaccaacaactccaggcaaacgccccaaactgatgatttatgatgtcaataatcggcctcgaggggtttctaatcgtcttcctctgctcaagtctgcacacggcctccctgacatctctggcctcgagggtgaggacgaggctgtaattatactgcagctactatttacaaagcacgacaccaactcgtagtcttacgggaactcgggaaactaacgggtcaaccgtccgtacggtcacgcccgaacggcccaacccgatcgtaccactttccg

SEQ ID NO: 397720 - DNA, 552 bp, Homo sapiens
  misc_feature: GZ8MTXP02H55R7.3.37.D04.1.454.CMB.2.raw
  modified_base (252)..(252): a, c, t, g, unknown or other
  modified_base (266)..(266): a, c, t, g, unknown or other
  modified_base (297)..(297): a, c, t, g, unknown or other
  modified_base (317)..(317): a, c, t, g, unknown or other
  modified_base (358)..(358): a, c, t, g, unknown or other
  modified_base (421)..(421): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattangtctctgtaccaanactccaggcaaagccccaaatgatgatttangatgtcaaataatcggcctnaggggtttactaatcgcttctctgctcaagtctggcaaacncggccctcctgaccatctctggctccgagggtgaggacgaggctagattatactggcagcttnaagtttacaacgcagactacccacttacgagtacgttacggaactgggaaacttaacggtacgtaaccgttccgtacggtaccacgaacccgaacgggacccctaaccccgatccgtactaaccgttcccg

SEQ ID NO: 397721 - DNA, 523 bp, Homo sapiens
  misc_feature: GZ8MTXP02JXSBK.3.37.D04.1.454.CMB.2.raw
  modified_base (242)..(242): a, c, t, g, unknown or other
  modified_base (396)..(396): a, c, t, g, unknown or other
  modified_base (412)..(412): a, c, t, g, unknown or other
  modified_base (435)..(435): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttgganatataattatgtctctgtacaacactccagcaacgccccaatgatgatttatgatgtacaataatcggccctgtagggtttctaatcgcttcctctgctacagtctgcaacgaccggcctcctgaccatctcgtggctccgagggtgaggacgnggctagattatactgnagctacattacaagtcagcaacnctcgagtctacggactagggactacggtaccacgtacctacggtccacgaacccgaacggacccaacccgactcgtacctacttcccg

SEQ ID NO: 397722 - DNA, 509 bp, Homo sapiens
  misc_feature: GZ8MTXP02HCP7U.3.37.D04.1.454.CMB.2.raw
  modified_base (301)..(301): a, c, t, g, unknown or other
  modified_base (321)..(321): a, c, t, g, unknown or other
  modified_base (500)..(500): a, c, t, g, unknown or other
tcagagacgcactccacgaccggtgctcgatttagtagcatactgttgggtttgggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaatgatgatttangatgtcaataatcggccctnaggggtttctaatcgtcttctctgctcaagtctggcaacacggcctccctgaccatctctgggctccgagggtgaggacgaggctgattatactgctaagctacatttacaaagcagcacactcagtcttcggaactgggactaaggcaccgtcgtagtcagcccaaggcccaacccancgtcactcc

SEQ ID NO: 397723 - DNA, 543 bp, Homo sapiens
  misc_feature: GZ8MTXP02G9KTI.3.37.D04.1.454.CMB.2.raw
  modified_base (243)..(243): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtanatatattatgtctctggtaccaacaactcccaggacaaacgcccccaaatcgatgatttatgatgtacaaataatcgcctgtagggtttctaatcgtcttcctctgctcaagtcgtgcaacacggccctcccgtagaccatctcgtcgggtctccgagggtgaggacgaggctagtagttatacgtgactagcttactaagttacaagcagcaacactcgagtctacgaacgtggaactaacgtcacgtcttacggcacgaacccgaacggacccaacccgtactacgtacctacttccg

SEQ ID NO: 397724 - DNA, 516 bp, Homo sapiens
  misc_feature: GZ8MTXP02FIN4A.3.37.D04.1.454.CMB.2.raw
  modified_base (240)..(240): a, c, t, g, unknown or other
  modified_base (444)..(444): a, c, t, g, unknown or other
  modified_base (508)..(508): a, c, t, g, unknown or other
  modified_base (513)..(513): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctggtctcctgaacagtcgatcaccatctcctgcactggaaccagcagtgacgttgganatataattatgtctcctggtaccaacaactcccaggcaaagcccccaaactgatgatttatgatgtcaataatcggccctcgaggggtttctaatcgtcttcctctggctccaagtctggcaacacggcctccctgaccatctctgggctccgagggtgaggacgaggctgattatactgcagctcatttacaagcagcaaccnctcaggtcttcggaaactgggactaaggtcaaccgtcctaggcacgcccaaggcccaaaccccntcacnctc

SEQ ID NO: 397725 - DNA, 551 bp, Homo sapiens
  misc_feature: GZ8MTXP02IIXBC.3.37.D04.1.454.CMB.2.raw
  modified_base (306)..(306): a, c, t, g, unknown or other
  modified_base (412)..(412): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctctgtaccaacactccagcaaacgcccccaaactgatgatttatgatgtnaataatcgcctcagggtttctaatcgcttcctctgctcatctgcacacggcctcctgaccatctctgggctccgagggtgaggacgaggctgtatatctgcagctnattacaagcagcaccaactcgtaaggtcttacggaacgttagggacgttaaacggtaccaccgtccgtaacgggttccaaccgaacccgaaaacgggacccccgaaaccccctactaccggttacaacccgtttccccg

SEQ ID NO: 397726 - DNA, 527 bp, Homo sapiens
  misc_feature: GZ8MTXP02H4H54.3.37.D04.1.454.CMB.2.raw
  modified_base (243)..(243): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtanatataattatgtctctggtaccaacaactcccaggcaaacgcccccaaatgatgatttatgatgtacaataatcggcccttgaggggtttctaatcgtcttcctctggctactaagtctcgcaacacggccctcctgaccatcctctggctccgagggtgagacgaggctgattatactgactagtctctatttacaagcacgcaccactcgagtcttacggactgggtaactagtcacgtcctacggtcacgaaccgaacggacccacccactcgtcacgtcc

SEQ ID NO: 397727 - DNA, 724 bp, Homo sapiens
  misc_feature: GZ8MTXP02I34YW.3.37.D04.1.454.CMB.2.raw
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgataccactctcctctcgctacgtacgaacagacgtagtacgtacggttaggtaatattaattaattgtcgtccttcgtacgtaaccaaactaccctaccgacgaacaaaccccgaaccccaagtgatattaatttagagtactacgtaactaaagtaccggtcccgtaccgtacgggtttacgggtttaactacgtccgttcttcccgtcgtcgtcctacgtacgtcgtacgacaaccgccgtccctccgacgactcttccgtcgtcggtcccaggggtagggtagaacgggtacgtcggtactagttattacgtcgtcgacgttagtaccttacgttaactaacgacgactaccgacctacgaacgttcggtacgttccggtaacggtaacggttacgggtaaacgtaccggtacccgttaaccggttacggtaaccggacccgaacccgtaaaccccggggaaacccgtaaccccctaaaacccgtcggttacccgtacccgtttaacctttacccccgg

SEQ ID NO: 397728 - DNA, 506 bp, Homo sapiens
  misc_feature: GZ8MTXP02JM3QH.3.37.D04.1.454.CMB.2.raw
  modified_base (226)..(226): a, c, t, g, unknown or other
  modified_base (242)..(242): a, c, t, g, unknown or other
  modified_base (494)..(494): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccngcagtgacgttggtanatataattatgtctctgtacaacaactccaggcaaagcccccaaactgatgatttatgatgtcaataatcggccctgaggggtttctaatcgtcttcctctggctcaagtctgcaacacggcctcctgaccatctctggctccgagggtgaggacgaggctgtattattactgcagctcatttacaagcagcacactcagtctcggaactgggactacgtcacgtctacggtcagcccgaacgccaaacccnctacgtcactcc

SEQ ID NO: 397729 - DNA, 551 bp, Homo sapiens
  misc_feature: GZ8MTXP02JSJTH.3.37.D04.1.454.CMB.2.raw
  modified_base (227)..(227): a, c, t, g, unknown or other
  modified_base (242)..(242): a, c, t, g, unknown or other
  modified_base (300)..(300): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccngcagtgacgttgganatataattatgtctctggtaccaacaactccaggcaaacgccccaaatgatgatttangatgtacaataatccggcctagtagggtttctaatcgtcttcctctggctccaagtctggcctaacacggccctcccgtgaccatctcgtgggcctccgagggtgaggacgaggctagatttatactgctagctactaattacaaagcaacgccaaccactcgaggtctacggaacgtgggacctaacgggtccaccgttcgtacggtccacggcccgaaacggacccaacccagtacgtaccacttcccg

SEQ ID NO: 397730 - DNA, 682 bp, Homo sapiens
  misc_feature: GZ8MTXP02I6OYC.3.37.D04.1.454.CMB.2.raw
  modified_base (242)..(242): a, c, t, g, unknown or other
  modified_base (251)..(251): a, c, t, g, unknown or other
  modified_base (291)..(291): a, c, t, g, unknown or other
  modified_base (303)..(303): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctcgtgtctgggtctcctggacagtcgatcaccatctcctgcactggaaccagcagtgacgttggtanatataattntgtctctgtaccaacaacctccagacaaccgaccccaatnatagtatttagngtatgtactaaatacgtcccgccttacggtacgggttactacgtcgtacttcctcgtcgtacctaccgtaacgttccgtcggaccaaaccgtacccggtccccttacccgtacgtaaacctcttcccgtccgtcggggtaccctccgggtaaggggtacgggaagggacggaccggtcgttaagtaacgtttacttagtacgacgtacttccgttaattacgttaagaacgtcgaacgtaccaaccgtacgtcggaggttaccgtaacgggtaacgtagggttaaacgtaaaccgggtcctaaacccggttcgtaaacggggtccaaaccggtccccgaaaccggacccctaacccgtacgtcgtacctactttccccg

SEQ ID NO: 397731 - DNA, 676 bp, Homo sapiens
  misc_feature: GZ8MTXP02JDZ2E.3.37.D04.1.454.CMB.2.raw
  modified_base (226)..(226): a, c, t, g, unknown or other
  modified_base (241)..(241): a, c, t, g, unknown or other
  modified_base (283)..(283): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcacatctcctgcactggaaccngcagtgacgttgganatatattatgtctctgtaccacactccagacaacgccccaangatgatttatgatgtactaataactccggtcctacgtacggggtttactaagtccgtctttcctcctcgtacctccgtaagtccgttaggccaaaccgacccggtcccttaccccgtgtacccgtcctcgtcgggcctaccgacgtcctaggagtatcggacggtcttagtaatttaacgttacgtgtacgtacggtaccgtactaatttaacgtcgtaccgaacgggttactaacgtaacctaaaccgtttaacgtttccggggttttaccggggacggggtaaaccgggaaccgtaaacggtccgttaccggtacccgttacccgttaacgggtaaccgtaccgtaaccccggaacggtccctaccccggtcccccggttacggttacccc

SEQ ID NO: 397732 - DNA, 593 bp, Homo sapiens
  misc_feature: GZ8MTXP02G6M1Z.3.37.D04.1.454.CMB.2.raw
  modified_base (227)..(227): a, c, t, g, unknown or other
  modified_base (242)..(242): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccngcagtgacgttgganatataattatgtctctggtaccaacaactccaggacaaacgcccccaaactgatgatttatgatgtacaataatccggccctcgtaggggtttactaagtcgtcttccgtctggctaccaagtctgggctaaacgacggccctccctgaccatcctctggggccttccgaggggtcgaggatggaggctaggtattattaacgtgactagctactatatgcgaggctaacttacaaacgtacgttggttttaccgggcgggtaaacgggacctaaggccgtacggaccccgttacgtaacggtcgaaccgtacccgaacggtccgtacccgtcccccgtacggttaccccg

SEQ ID NO: 397733 - DNA, 543 bp, Homo sapiens
  misc_feature: GZ8MTXP02IJKKK.3.37.D04.1.454.CMB.2.raw
  modified_base (301)..(301): a, c, t, g, unknown or other
  modified_base (444)..(444): a, c, t, g, unknown or other
  modified_base (458)..(458): a, c, t, g, unknown or other
tcagagacgcactccacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactgaaccagcagtgacgttggtagatataattatgtctctgtaccaaacaactccagacaaacgaccccaaactgatgatttangatgtacaaataatcggacccttacgtaggggtttactaatcgtactttcctctggctcaagtctagccaaacacggtccctccctagacctatctctggcctccgagggtgaggacgaggctagattatacagacagcttanaatttacaagcaancacactcagtacttacggacgtaggtactaacgtcacgtactacggtcacgaaccgaaacggccaacccactacgactactaccg

SEQ ID NO: 397734 - DNA, 727 bp, Homo sapiens
  misc_feature: GZ8MTXP02IHK88.3.37.D04.1.454.CMB.2.raw
  modified_base (244)..(244): a, c, t, g, unknown or other
  modified_base (256)..(256): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcacgtggaaccagcagtgacgttggtanattaatattatntctctgaccaacactccagacaaacgccccaatgatgatttatgatgtactaataacgtcgtccctgtagggtttactaactcgtctttcctacgtcgtctacgaagttcgtcggaccaaacgtccggtaccccttaccccgtacgtaccctaacttccttccgtagggcccttaccgggaggggttacggaacggggtacggacgggtccgttaggttaaacttaacgtttactacggtacctaacgttccgttaacgttaacttttaaaccgaaagtcccgaaacgtaccctaacctaaccgtttaccgtacggtttacccggttaacccggggttaaaacgttacgggggtaaaacccgtttaaacgggttacccggtaaccccggtttaccgtaaccggttccaaaccggaaccccgtaaaccgacccccgtaaacccctacggtaccttaccgtaactttcccccg

SEQ ID NO: 397735 - DNA, 620 bp, Homo sapiens
  misc_feature: GZ8MTXP02HKJ5S.3.37.D04.1.454.CMB.2.raw
  modified_base (243)..(243): a, c, t, g, unknown or other
  modified_base (299)..(299): a, c, t, g, unknown or other
  modified_base (604)..(604): a, c, t, g, unknown or other
tcagagacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcacgtggaaccagcagtgacgttgganatataattatgtctctgtaccaacactccagacaaacgccccaaatgatgatttangatgtacaataacgtccggtccctagtaggggtttactaagtcgtcttccgtcgtggtacctacgtaagtcgtcggacaaccgtaccggtccctcccgtacgacctattccgtcgtcgggtacccttccggaggggtacgaacgggacgtacgggtctaggtaatttacgtacgtcgacgtaagtcttactaagttacgaagccgaacacctaccgtaacgtcgtaaggttccgtaacggacgtacggggtactaacggtacctaccgtacgtacgtaccacgaacccgaacgaccctaaacccngtacgactacttcccg

SEQ ID NO: 397736 - DNA, 616 bp, Homo sapiens
  misc_feature: GZ8MTXP02FOW73.3.37.D04.1.454.CMB.2.raw
  modified_base (245)..(245): a, c, t, g, unknown or other
  modified_base (306)..(306): a, c, t, g, unknown or other
tcagagacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtcctccgtggacagtcgatcaccatctcctgcactggaaccagcagtgacgttgganatataattatgtctcctgtaccaacaactccagacaaacgacccccaaatgatgtatttanagatgtacaataatccggccctgtagggtttacaagtcgtcttcctctgctactaagtctaggccaaccgacggtccctccctgaccactctcgtcggtcctaccgagggtgaagggacggaggtctagtacttagttactggcagtctactagtttaacagtacacgacacctactacgtacgttcgttaaccgggaaacgttcggggtaaacttaacgggtacctaacccggttcccgtaacggtcccgaaaccggccccgaaaccggacccccaaaacccctcgtaccgtccctaacctttccccgg

SEQ ID NO: 397737 - DNA, 517 bp, Homo sapiens
  misc_feature: GZ8MTXP01AJ7U6.13.33.C11.1.454.CMB.2.raw
  modified_base (347)..(347): a, c, t, g, unknown or other
  modified_base (442)..(442): a, c, t, g, unknown or other
  modified_base (493)..(493): a, c, t, g, unknown or other
  modified_base (497)..(497): a, c, t, g, unknown or other
tcagtcacgtactacacgaccggtgctcgatttagagtgagctcgttgggtttggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgccanaaaagtttgcacagaactttcaggacagggtcacatgaccacggacacgtaccatcaacacagacctacatagggggaactggaggagcctaagntctagacgacacggtccgtttataatgttgcaaagtaagaattgcaaacgntgtntttgattagtgttgggaacg

SEQ ID NO: 397738 - DNA, 537 bp, Homo sapiens
  misc_feature: GZ8MTXP01CBZJ5.13.33.C11.1.454.CMB.2.raw
  modified_base (196)..(196): a, c, t, g, unknown or other
tcagtcacgtactacacgaccggtgctcgatttagagtgagctcgttgggtttgggctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggcccctgtggtggtcatctataggggataataaccggccctctgggatccctgaccgattctctggctccccaactcggggaacacggccaaccctgccatcaaacagagcccaagacggggatgaggctgactattattgcaggtgtgggacagcacgacggtgatagtcggcggcgggacaagctgaccgtctaggtcagcccaaggcctcgcccccttcggttcacctctcgttccccgccctccgttctaacgttcgtcg

SEQ ID NO: 397739 - DNA, 540 bp, Homo sapiens
  misc_feature: GZ8MTXP01BB3NP.13.33.C11.1.454.CMB.2.raw
  modified_base (222)..(222): a, c, t, g, unknown or other
  modified_base (283)..(283): a, c, t, g, unknown or other
  modified_base (417)..(417): a, c, t, g, unknown or other
  modified_base (507)..(507): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagagcctggggcctnagtgaaggtctcctgcaagacctctggatacaccgtcaccgacgaccatatatactgggtncgacaggcccctggacaaggccttgagtggatgggacatatcagccctgtccagtggtgccataaaagttgcacagtaactttcgaggacagggtcaccatcgacacggacacgtaccatacaacacagcctanatggggaactggagagacctaagactcgtacgacgtacacggtccgtttaattaattgttgacttaaagtaaagaattagacaaacggtnttgtcttttagagttagtgggttcggggaaccg

SEQ ID NO: 397740 - DNA, 561 bp, Homo sapiens
  misc_feature: GZ8MTXP01BCNUZ.13.33.C11.1.454.CMB.2.raw
  modified_base (373)..(373): a, c, t, g, unknown or other
  modified_base (419)..(419): a, c, t, g, unknown or other
  modified_base (526)..(526): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactggggctggatccggcacgcccccgagggaagggctggagtggagttggggatatctcttatagtgggagtacgaactacaatccgtcctcaagacgtcgagtcatcaatatccgtanacaggtccaggaacgattctcctagaaagtgagttctgtgaccgtncagacacggctgtctattagttgtgcgtagaccggataaatagtggttacgagggtagttcgaacttcggtggggaccgacgggaacccttcgggttcaccggttcnccgtcacggcccttccaacccgttaagggaacccc

SEQ ID NO: 397741 - DNA, 541 bp, Homo sapiens
  misc_feature: GZ8MTXP01CIOEW.13.33.C11.1.454.CMB.2.raw
  modified_base (487)..(487): a, c, t, g, unknown or other
  modified_base (514)..(514): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagaagccgtggggcctcagtgaaggtctcctgcaagacctctggatacaccgtcaccgacgaccatatatacgtggtgcgacacggcccctggacaaggccttgagtggagtgggacatatcacgccctgtccaggtggtcgccaactaaaagtttgcacaagtactttacaggacgagggtcaccatcgaccacggacacgtaccatacaacacacgacctacagtaggggaactagaggacgacctaagatctagacgtacgacgtcgtttatntgttgacaagtaagtaattgacaagtntgtctttagattagtggttcgggaacg

SEQ ID NO: 397742 - DNA, 589 bp, Homo sapiens
  misc_feature: GZ8MTXP01CJQIH.13.33.C11.1.454.CMB.2.raw
  modified_base (216)..(216): a, c, t, g, unknown or other
  modified_base (236)..(236): a, c, t, g, unknown or other
  modified_base (336)..(336): a, c, t, g, unknown or other
  modified_base (390)..(390): a, c, t, g, unknown or other
  modified_base (400)..(400): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagctggggctnagtgagtctctgcaagcctntggatacaccgtcaccgacgaccatatatactgggtgcgacacggcccctggacaaggccttgagtggatgggacagtatcagcctgtcagtgtcgccanaagtttgctaacagtaacttgaggacagggtcacatcgaccacggacacgtcanacaacacacncacatacggactggaaggggacgtaccgtaaaggacttacgtacggacgaacctaccggggtaccgttttattagttaggttaagtaacgtaaagttaaaggtaagttacgtaaacgtaaacgttagttacgttacgtttaagtagttaaggtacgggtacggggttacggtaacgggttaacgtaacg

SEQ ID NO: 397743 - DNA, 557 bp, Homo sapiens
  misc_feature: GZ8MTXP01CIJL6.13.33.C11.1.454.CMB.2.raw
  modified_base (241)..(241): a, c, t, g, unknown or other
  modified_base (401)..(401): a, c, t, g, unknown or other
  modified_base (464)..(464): a, c, t, g, unknown or other
  modified_base (468)..(468): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccagggctggtgaagccttcgacgaccctgtccctcacttgcactgtctcagtgctcattaaaccngcagtatcacgtggggtgatccggcacggcccccggggaaggagcgtggagtggagtggggagatttatatactggacaaatacttacgacaaactccgtcctacaagtagtcgagtccaaccctgtccgtgacacgccgaaataccagtctccctgacncctgaccttcgtgtcgaccgccgcgactccggcctatacgttctgtcgacgagagatcgaagntgtntccagttcggcggggcttacgttttgaacttgttccggttggggacccgtaaagggtccgtaagttcgggtcagttccgttctttcccg

SEQ ID NO: 397744 - DNA, 556 bp, Homo sapiens
  misc_feature: GZ8MTXP01EB30L.13.33.C11.1.454.CMB.2.raw
  modified_base (270)..(270): a, c, t, g, unknown or other
  modified_base (342)..(342): a, c, t, g, unknown or other
  modified_base (423)..(423): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatanatactgggtgcgacaggcccctggacaaaggccttgagtggatgggacatatcagccctgcagtgtcgccanaaagtttgacaaacaagtaactttcgaaggtacagggtcaccatacgaccacggacacgtacatcaaacacagccctaaanagtagaactgagggacgtactaagactacgacgacgacgtacgttacgtttattatgagaataaagttaaagtaattagaaactaagttagttgttacgtttaagataagtgggacggacgtaaggaactaag

SEQ ID NO: 397745 - DNA, 625 bp, Homo sapiens
  misc_feature: GZ8MTXP01A032A.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagccgtggggcctcagtgaaggtctcctgcaagacctctggatacaccgtcaccgacgaccatatatacgtgggtgcgacaggcccctggacaaggccttgagtggatgggacatatcagccctgtcagtggtcgaccaagtaaagtttcgacaaacagtaactttcgagggacagggtccacgatcgaccacggacacgtcatacaacgacagcctaacagtaggaactaggaggggaacgaccttaagactacgtacgaaccgaaccgtaccgggttaccgttttaagttaacgtttggtacggtaactaaaagttaaaggtaaagtttacgaaaccgtaaaacgttagtttggttaccgtttttaagaagtttaagtggggttacgggggacccgtaaagggggttaactaaccgg

SEQ ID NO: 397746 - DNA, 535 bp, Homo sapiens
  misc_feature: GZ8MTXP01E0TEX.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatggggacatatcagccctgtcagtggtcgccacaaagtttgcaacagaactttcaggacagggtcacatcgaccacggacacgtccatcaaacacagcctacatggaactgagggagacctaaagatctgacgacacggccgtttattattgtgctaaattaaagaaattgacaaacgagttgcttttaagattaagtggtggggaccaaggggttaactaacg

SEQ ID NO: 397747 - DNA, 569 bp, Homo sapiens
  misc_feature: GZ8MTXP01B4E15.13.33.C11.1.454.CMB.2.raw
  modified_base (346)..(346): a, c, t, g, unknown or other
  modified_base (468)..(468): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactggggctggatccggcacgcccccgagggaagggctggagtggagttggggatatctcttagtagtgggatacgaactacaatccgtcctnaagacgtcgagtcatcaatatccgtagacaggtccaggaacgaattctaccctagaaacgtgagttctgtacgaccgtcgcagacacggctgtactatttatgtgacgagacggacaaagtntggttacaggggtattcgacgttacgtggggccacggggaacccttgggttccacccggttctccctcgaccgtcccttacccgaaccgttaacgggcccc

SEQ ID NO: 397748 - DNA, 575 bp, Homo sapiens
  misc_feature: GZ8MTXP01CTRP3.13.33.C11.1.454.CMB.2.raw
  modified_base (376)..(376): a, c, t, g, unknown or other
  modified_base (465)..(465): a, c, t, g, unknown or other
tcagtcacgtactacacgaccggtgctcgatttagagtgagctcgttgggtttgggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactacgtggggctggatccggcagcccccgagggaagggctggagtggagttggggatagtctcttagtagtgggagtacgaactacaatccgtaccctacaagacgtcgagtcatcaatatcganacaggtcagaacgatctcctagaaacgtgagttctgtacgaccgtgacagacacggctcgtatatttatgtagcgagacggataaagtntggttacgaggggtagttccgaacgttacggttcggggcccgtaaggggaaccccttcggttccgacccgtctccctcgacggtcccacccgtaaccgaaccgggtcccc

SEQ ID NO: 397749 - DNA, 657 bp, Homo sapiens
  misc_feature: GZ8MTXP01DNGXT.13.33.C11.1.454.CMB.2.raw
  modified_base (271)..(271): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagcctggggcctcagtgaaggtctcctgcaagacctctggatacaccgtcaccgacgaccatanatactgggtgcgacacggcccctggacaaggccttgagtggatgggacatatcagccctgtcagtggtcgaccaactaaagtttgacaaaccaagtaacctttcgaagggaacgacggggtaccaccgatcgacccacgggacaccgtccaatacaaacacacgacctaacataggaactaggaagggggacgaccgtaaagacttacgtaggaaccgaacgtaccgggttaccgttttaagttacgtttaggtaggtaacctaaaagttaaaggtaaatttacggaaacgtaaaaccgggttactttcgggttactttttaaggtaagtttaacggttaggggtacgggggttaccccgtaaagggggttaaccttaaacccggg

SEQ ID NO: 397750 - DNA, 529 bp, Homo sapiens
  misc_feature: GZ8MTXP01BM8RG.13.33.C11.1.454.CMB.2.raw
  modified_base (272)..(272): a, c, t, g, unknown or other
  modified_base (427)..(427): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgaaagacctctggatacaccgtcaccgacgaccatatanactgggtgcgacaggcccctggacaaggccttgagtggatgggacatatcagcctgtcagtgtgccccacaaagtttgcacaagaactttcaggacagggtcaccatgaccacgacacgtcatcaacacagctacatgaactgagagcctaaagntactgacgacacggtaccgttattattgtgacaataaagaattgactaaaacgattaggttcttttggaattagtggttggggccaaggggaacaacgtaag

SEQ ID NO: 397751 - DNA, 627 bp, Homo sapiens
  misc_feature: GZ8MTXP01D3QXJ.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctcctgcaagacctctggataccaccgtcaccgacgaccatatatacgtgggtgcgacacggcccctaggacaaggccttgaggtggatgggacatatcagccctgtcaggtggtcgccaactaaagtttcgacaaacagtaactttcgaagggacaggggtcacgatcgacccacggacacgtccaatacaaacacagccctaacagtacggaaactggaagggggaacgtaccgtaaaggactctacggaaccgtaacgtaaccgggttccgttttaatttacgttggtcggtaactaaagttaaagtaaatttaggaaacctaaaacggttatttcggttactttttaagagttaacggttggggtacggggacccgtaaagggggttaacctaagg

SEQ ID NO: 397752 - DNA, 593 bp, Homo sapiens
  misc_feature: GZ8MTXP01EQG3Z.13.33.C11.1.454.CMB.2.raw
  modified_base (284)..(284): a, c, t, g, unknown or other
  modified_base (552)..(552): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctcctgcaagacctctggatacaccgtcaccgacgaccatatatactgggtncgacaggcccctggacaaggccttgagtggatgggacatatcagccctgtccaggtggtgccaactaaaagtttgcacagtaactttcgaggacagggtccaccatgaccacggacacgtaccatacaacacacgcctaacataggggaaactggaacggacgacccgtaaagacttacgtacggaaccgacgtaacgggttacccgttttaattaagtttggttacggacttaaaagtaaagtaaattacggaaccttaaaacggtnttaggttctttttaggattagtgggttaacgggggtaaccg

SEQ ID NO: 397753 - DNA, 547 bp, Homo sapiens
  misc_feature: GZ8MTXP01EUL5E.13.33.C11.1.454.CMB.2.raw
  modified_base (392)..(392): a, c, t, g, unknown or other
  modified_base (409)..(409): a, c, t, g, unknown or other
  modified_base (430)..(430): a, c, t, g, unknown or other
  modified_base (455)..(455): a, c, t, g, unknown or other
  modified_base (460)..(460): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtagactacttactactggggctggatccggcacgcccccgagggaagggctggagtggatggggatatctcttatagtgggagtacgaactacaatccgtcctacaagacgtcgagtcatcaatatccgtagacaggtcaaggaacgaattcncctagaaagtgagttcngtcgaccgtcgcagacacggntcgtctattatgtgcgtagaccggnaaatntgggtcagggtatcgacttacgtcggggacacgggaaccttggttccaccggtctccctcacgcccttccgaaccgaacgggtcccc

SEQ ID NO: 397754 - DNA, 635 bp, Homo sapiens
  misc_feature: GZ8MTXP01EBOS2.13.33.C11.1.454.CMB.2.raw
  modified_base (285)..(285): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtncgacaggcccctggacaaggccttgagtggatgggacatatcacgccctgtccaggtggtcgccaactaaaagttgcacagtaacttcgaggacagggtcacatgaccacgacacgtacatacaacacacgacctaacagtacgggggaaactggaagggaacgtacccgtaaaggacttaccgtaacggaaccgtaaccgtaaccgggttacccgttttaaagtttaacgtttaggttacgtaaacttaaaagttaaacggtaaatttacggaacccgttaaaaacgtaagttacgttaacgtttttaggaagtttaacggttaacggggttaacgggggtaaacccgg

SEQ ID NO: 397755 - DNA, 535 bp, Homo sapiens
  misc_feature: GZ8MTXP01B4L81.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgccacgaaaagtttgcacagaactttcaggacagggtcacatgacacggacacgtaccatcaaacacacgactacatcggggaactaggaaggagacctaaggatactagacgacgacggtccgttattaatgttgacaagtaaagtaattagacaaagtaatgtaattttggattagtggttggggtaacg

SEQ ID NO: 397756 - DNA, 578 bp, Homo sapiens
  misc_feature: GZ8MTXP01EY6B1.13.33.C11.1.454.CMB.2.raw
  modified_base (536)..(536): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagccccactcccaggtgcagctggtgcagtctggggctgaggtgaagagcctggggcctcagtgaaggtctcctgcaagacctctggatacaccgtcaccgacgaccatatatactgggtgcgacaggccccctggacaaggccttgagtggatgggacatatcagccctgcagtgtcgccaataaagttgacaacagtaactttcgagggacagggtcaccgatacgaccacggacacgtaccatcaaacacacgcctacactggaactggacggggagaccgtaaagacttacgacggaaccgacgtaaccggttaccgttttaagtttacgttaggttgaactaaagttaaaggtaaatttaggaactaaacgnttgttctttgtataagtggtagggaccgtaaggaacgtaacg

SEQ ID NO: 397757 - DNA, 548 bp, Homo sapiens
  misc_feature: GZ8MTXP01AX6Y1.13.33.C11.1.454.CMB.2.raw
  modified_base (346)..(346): a, c, t, g, unknown or other
  modified_base (363)..(363): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagaagccgtggggcctcagtgaaggtctctgcaagacctctggatacaccgtcaccgacgaccatatatactgggtgcgacacggcccctggacaaggccttgagtggatgggacatatcagccctgtccaggtggtcnccactaaaagtttgcanagtaactttcgaggacagggtcacatcgacacggacacgtaccatacaacacacgcctacatggggaactggacgagacctaagactcgtagacgacgtacggtaccgtttaattaattggttagacaaagtaagtaattagacttaacggtaatgtaacgtttagattagtcggttgggaaccg

SEQ ID NO: 397758 - DNA, 555 bp, Homo sapiens
  misc_feature: GZ8MTXP01DGW8E.13.33.C11.1.454.CMB.2.raw
  modified_base (530)..(530): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctctgcaagacctctggatacaccgtcaccgacgaccatatatactgggtgcgacacggcccctggacaaggccttgagtggatgggacatatcagccctgtccagtggtgaccacaaaagtttgcactagtaactttacgaggacgagggtcacatcgacacggacacgtcactacaacacacgacctacatacggggaaactggaacggagacctaaaggactcgtagaccgtacgacggtcctttagttaacttgttgtacaaagtaaagtaatttaggaccaaagtaatcgtnttttagattagtggttggggaaccg

SEQ ID NO: 397759 - DNA, 651 bp, Homo sapiens
  misc_feature: GZ8MTXP01A2NSZ.13.33.C11.1.454.CMB.2.raw
tcagtcacgtactacacgaccggtgctcgatttagagtgagctcgttgggtttgggggcagcacccagcacctacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcagtgaaggtctcctgcaagacctctggatacaccgtcaccgacgaccatatatacgtgggtgcgacacggcccctggacaaggcctgagtggatgggacatatcagccctgtcccaggtggcgacccaacgtaaaaagtttcgcaactaagtaactttcgaacgggacaggggtacccaaccagtacgaccgacggacacgtaccaataccaacacacgacctaacagtacggggaacgtaggacgggacgtaccgtaaagacttacgtacggaaccgtaaccgtaacgggttcccgttttaagttaatttcggttaacgtacgttaaaagttaaaaggtaaacgtttagaaaccgttaaaacggtaagttaggttaacgtttttaaggagtttacggttaagggttaacgggggtaaacccggg

SEQ ID NO: 397760 - DNA, 532 bp, Homo sapiens
  misc_feature: GZ8MTXP01A6PH2.13.33.C11.1.454.CMB.2.raw
  modified_base (286)..(286): a, c, t, g, unknown or other
  modified_base (451)..(451): a, c, t, g, unknown or other
  modified_base (486)..(486): a, c, t, g, unknown or other
  modified_base (488)..(488): a, c, t, g, unknown or other
  modified_base (509)..(509): a, c, t, g, unknown or other
  modified_base (513)..(513): a, c, t, g, unknown or other
  modified_base (526)..(526): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagccgtggggcctcagtgaaggtctcctgcaagacctctggatacaccgtcaccgacgaccatatatactgggtncgacaggcccctggacaaggccttgagtggatgggacatatcagccctgtccagtggtgccacaaaagtttgcacagtaactttcgaggacagggtcaccatcgaccacggacacgtaccatacaacacacgtacctacatagggggaactggagagacctaagntactgacgactacgggtcctttaataattggttananaaagtaagtattagacaagtntgtnttgattagtcggnggaacg

SEQ ID NO: 397761 - DNA, 538 bp, Homo sapiens
  misc_feature: GZ8MTXP01DSAHP.13.33.C11.1.454.CMB.2.raw
  modified_base (218)..(218): a, c, t, g, unknown or other
  modified_base (466)..(466): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctnagtgaagtctcctgcaagacctctggatacaccgtcaccgacgaccatatatactgggtgcgacacggccccctggacaaggccttgagtggatgggacatatcagccctgtcaggtgtcaccataaagtttgacaacagtaactttcgaaggacagggtccacatcgaccacgacacgtcatacaacacagcctacatagaactgagggagacctaagactctagacacgacggtcgtttatattgngaactaattaagtattagaacaagttattgttactttgattgtggtacgggttacgaacgggttaactaacg

SEQ ID NO: 397762 - DNA, 640 bp, Homo sapiens
  misc_feature: GZ8MTXP01EOXRW.13.33.C11.1.454.CMB.2.raw
  modified_base (242)..(242): a, c, t, g, unknown or other
  modified_base (269)..(269): a, c, t, g, unknown or other
  modified_base (279)..(279): a, c, t, g, unknown or other
  modified_base (284)..(284): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctcctgcaagacctntggatacaccgtcaccgacgaccatanatactgggtncgacnggcccctggacaaaggccttagagtggatgggacatatcagccctgtcagtgtcgccacgaaagtttcgactaacagtaactttcgaagggacagggtcacctatcgacacggacacgtaccatacaacacagccaacatacggaactgaaggggacgtacctaaagacttacgacgaacggaaccgtaaccgggtacccggtttaatttaacgttcgggttaaacgtaaacgtaaaacgttaaacggttaacgttaacggtaaaccgtaaaacggttacgttcggtttaacgttttaacggtaacgttaacgggttacgggtacggggttaaccgtaaacgggttaaccgtaacg

SEQ ID NO: 397763 - DNA, 565 bp, Homo sapiens
  misc_feature: GZ8MTXP01ED762.13.33.C11.1.454.CMB.2.raw
  modified_base (199)..(199): a, c, t, g, unknown or other
  modified_base (217)..(217): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcggccccggganagacggccacaattcccngtgaggaaacaaccttagaagtcagaatgtccactggtaccagcagaagtcaggccaggcccctgtggtggtcatctaatagggataagtaacccggccctcgtgggactccctgaccgattctctggcctccccgaacgtcggggaacaccggcccaaccctgaacccataccaaacagacgacccgaagacggggatgaggctgacttattagtgtcgaggtgtgggacagcacggacggtgatagtcggcggccggacaagcgtcgaccgtcgaggtcacgcccgaacggcgtccgcccccgttggttccaccgtcctcgtccccgccctcttcctcgttcgtcg

SEQ ID NO: 397764 - DNA, 609 bp, Homo sapiens
  misc_feature: GZ8MTXP01AD5T5.13.33.C11.1.454.CMB.2.raw
  modified_base (270)..(270): a, c, t, g, unknown or other
  modified_base (346)..(346): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatanatactgggtgcgacacggcccctggacaaggccttgagtggatgggacatatcacgccctgtcagtggtcgaccanaagtttgcaacagtaactttgaggacagggtcaccatacgaccacggacacgtcatcaacacacgacctacataggaactgaggggacgccgtaagactacgtgacgacgtaccggtaccgttttaagtttagttaggtcggtaactaaaagttaaaggtaaagtttacggaaacgtaaaaccgttagttaggttaccgtttttaaggaaacgtttaagttacgggttacgggggaccccgtaagggggttaaccttaaccgg

SEQ ID NO: 397765 - DNA, 700 bp, Homo sapiens
  misc_feature: GZ8MTXP01ES2EU.13.33.C11.1.454.CMB.2.raw
  modified_base (247)..(247): a, c, t, g, unknown or other
  modified_base (652)..(652): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagcgtgggctgagtgaaggtctcctgcaagacctntggataccgaccgtcaccgacaccatatatacgtggtgcgacgacggcccctaggaaccaaggtccttaggaggtgggagtgggaactagtactcgacgccctgtccaggtggtacgacccaagttaaaaagtttcgaactaacgtaaacgttaaacctttcggaacgggtaacgtacggggtacccaacctagtaccggaaccgaaccgggaacctaaccggtacccaactaccaaaccaacgaccgaccttaaacgagtacggggtaaacgttacgggaaacgggtacgaaccgtaaaggtacttaccggtacgaaaccggtaaccgtaaccggttaccggttttaaattaagttggttacgaaacttaaagttaaagtaacgttacggaaccttaaaaggtnttagttaacgtttggaatttacgggttgggtttaacgggtaaaccggg

SEQ ID NO: 397766 - DNA, 529 bp, Homo sapiens
  misc_feature: GZ8MTXP01AIQUX.13.33.C11.1.454.CMB.2.raw
  modified_base (490)..(490): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtcgccacaaagtttgacaacagaacttcaggacagggtcacatcgaccacggacacgtcatcaacacagcctacataggaactgaggggagacctaagactctagacgacacggtccgtttattattgtgaacaattaagtaattgacaaacgnttgttctttaagataagtggtggggaccaagggctaacg

SEQ ID NO: 397767 - DNA, 571 bp, Homo sapiens
  misc_feature: GZ8MTXP01E2PSK.13.33.C11.1.454.CMB.2.raw
  modified_base (270)..(270): a, c, t, g, unknown or other
  modified_base (413)..(413): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatanatactgggtgcgacacggcccctggacaaggccttgagtggatgggacatatcacgccctgtcagtggtcgccacaaagttgcaaacagtaacttgaggacagggtcacatcgaccacggacacgtcatacaacacagcctanataggaactgaacggggacgaccgtaaagactcgtagaaccgaaccgtaccgggtccgtttaattagttgtgaactaaagttaaagtaaattcggaactaaaacggattcgttacttttaagattaagtgggtacggggaccgtaaggggaactaacg

SEQ ID NO: 397768 - DNA, 652 bp, Homo sapiens
  misc_feature: GZ8MTXP01DALC5.13.33.C11.1.454.CMB.2.raw
  modified_base (245)..(245): a, c, t, g, unknown or other
  modified_base (283)..(283): a, c, t, g, unknown or other
  modified_base (322)..(322): a, c, t, g, unknown or other
  modified_base (453)..(453): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagccgtggggcctcagtgaaggtctcctgcaagacctntggatacaccgtcaccgacgaccatatatacgtgggtncgacacggcccctggacaaggccttgagtggatgggacntatcagccctgtcagtggtcaccaataagtttgacaaacgtagtaactttcgaacgggaactacggggtccaacgtataccgaacccgacgggaacctaccggtaccaataccaaacacgacgaaccctanaagtcggaaacgtggaacggggacgacctaaagactacgtacggaaccgtacgtaaccgggttaccgttttaagttacgtttagggtctaaacgtaaaattaaagggtaaacttagggaaacctaaacggttaattcgggttactttttaaggaattaaggttacgggtacgggggaacccaaaggggttaactaacgg

SEQ ID NO: 397769 - DNA, 699 bp, Homo sapiens
  misc_feature: GZ8MTXP01BBTK7.13.33.C11.1.454.CMB.2.raw
  modified_base (245)..(245): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtgggctgaggtgaagagcgtgggcctcagtgaaggtctctgcagacctntgatacaccgtcaccgacgaccatatatacgtgggtgccgacgacggcccctggaacgaaggtccttaggacggtgggagtacggggactaagtacgtcgaacgtcccttggtaccgtagggtcggttacggaccctaaacgtaaaaaacggttttcgaaccgtaaacgtaacggttaaacctttcgaacggggtaaccgtacggggttacccaacgtacgtaccggaaccccgaacgggaacctacggtaccctacaaccaaaccacgacgacccttaacgacggtacggggaaccgtagggaacggtacgtaacctaagacgttccggtaacgaccgtaaccgtacgggttaccgtttattaagttagttacgtaacttaaagtaaaggtaacttacgaacttaagtaattgttaacgttttaggagttaggtcgggttaacggggtaaccg

SEQ ID NO: 397770 - DNA, 634 bp, Homo sapiens
  misc_feature: GZ8MTXP01DWHJ9.13.33.C11.1.454.CMB.2.raw
  modified_base (248)..(248): a, c, t, g, unknown or other
  modified_base (286)..(286): a, c, t, g, unknown or other
  modified_base (350)..(350): a, c, t, g, unknown or other
  modified_base (375)..(375): a, c, t, g, unknown or other
  modified_base (451)..(451): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagcctggggcctgagtgaaggtctcctgcaagacctntggatacaccgtcaccgacgaccatatatacgtgggtncgacaggcccctaggacaaggccttaggagtggatgggacatatcacgcctgtccgaggtggtnacccaacgtaaaaagtttgaacaanaagtaacttcgagggactagggtaccaccagtacgacccgacggtacaccgtacaataccaacgacacgacctaanagtacgggaacgtaggacgggacaccgtaaggacttcgtacggaccgaacgtaccgggttaccgttttaataacgtttagttacggaaacttaaagtaaaagtaacgtttaggaaccttaaaaacggtttaagttacgtttaacgtttaggtaagttacgggtaacgggttaacggggaaccg

SEQ ID NO: 397771 - DNA, 629 bp, Homo sapiens
  misc_feature: GZ8MTXP01CCDZ1.13.33.C11.1.454.CMB.2.raw
  modified_base (273)..(273): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtgggcctgagtgaaggtctcctgacaagacctcgtggatacaccgtcaccgacgaccatanatacgtgggtgcgacgacggccccgtaggacgaaggccttgagtggagtagggacatatcgacgcccgtgtacaggtggtcgaccaacgtaaagtttgactaaacgaacgtaactttcgaagggacgacgggtaccaaccagtaccgaaccctacggaccaccgtaccaactaccaaaccacaacgtacctaacgaacgtagggaaacctagggaacggggaacgtaccgtaaagactacgtacgacgaacgtaccggtcctttaatattcgataacaaagttaacgtaagttacgaactaacgttagttcgttactttaagattaaggtcgggtacgggaccgtaagggctaacg

SEQ ID NO: 397772 - DNA, 632 bp, Homo sapiens
  misc_feature: GZ8MTXP01EEJAE.13.33.C11.1.454.CMB.2.raw
  modified_base (224)..(224): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagccgtgggctnagtgaaggtctctgcaagacctctggatacaccgtcaccgacgaccatatatacgtgggtgcgacacggcccctaggacaaggcttagagtggagtgggacatatcacgccctgtccaggtggtcgaccaactaaaaaagtttcgcaacgaagtaaaccgtttcgaacgggtacgaggggtaccaaccgaagtacgaacccgacggaacacgtaccataccaacacacgacctaacagtaggggaaactggaacggacgaccgtaaagactcgtacgaaccgtacgtaaccggttaccgtttaattaagttgttagtaaacttaaagttaaagtaaagttacgaaccgttaaaaggtaattacggttaactttttagaagttacgttaagggttcggggtaaacccgg

SEQ ID NO: 397773 - DNA, 610 bp, Homo sapiens
  misc_feature: GZ8MTXP01EQAO0.13.33.C11.1.454.CMB.2.raw
  modified_base (223)..(223): a, c, t, g, unknown or other
  modified_base (284)..(284): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagagcctggggcctnagtgaaggtctcctgcaagacctctggatacaccgtcaccgacgaccatatatactgggtncgacaggcccctggacaaggccttgagtggatgggacatatcacgcccctgtcccaggtggtcgccaaccgtaaaaagtttgcaactaggtaacctttcgagggtacgagggtccaaccatacgaccgacggaccacgtaccactacaacaacacgacctaacagtacggggaactggaaggtacgaccgtaaaggactaccgtaggaaccgtaacgtaccgggttaccgttttaagttaagtttgttaggtacttaaagtaaagtaagtttacggacttaaacggtaattagtcgttttagagttagtgggttggggtaacccgg

SEQ ID NO: 397774 - DNA, 755 bp, Homo sapiens
  misc_feature: GZ8MTXP01BR9UY.13.33.C11.1.454.CMB.2.raw
  modified_base (197)..(197): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccggganagaccggccacaattccctgtgaggaaacaacttagaagtcagaatgtccactggacagcagaagtcaggccaggcccctgtggtggtcatctagtagggataacgtaacccggccctgtcgggactccccgtgaccgtattcctctggcctccccgaacgtcgggggaacaccgggcccaaccccgtgaacccataccaaacacgacgaccccgaaagggacggggataggacggcctaggtaaccttagtttaacgtttggtaccgtaggggttagggttacgggggaaccaaggcccgaacccgggtaacggggttaggtaacgttaacggttccgggggacccggggacccggggaacccgtaaacgggtcccgtaccgggtaaccccggttacccgtaacggggttaacccgaaccggttacccccggaaacgggttccccgtaccccgggtccccccccgttccggggttcccttaccccgtttccccgttcccggtttcccccccggtcccccttccccgttcccgttaaccgggttaacccggttccggg

SEQ ID NO: 397775 - DNA, 578 bp, Homo sapiens
  misc_feature: GZ8MTXP01DBKND.13.33.C11.1.454.CMB.2.raw
  modified_base (271)..(271): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggataccaccgtcaccgacgaccatanatacgtgggtgcgacacggccccctggacaaggccttgagtggatgggacatatcagccctgtcagtggtcgccaataagtttgacaacagtaactttcagggacgagggtcaccatcgaccacggacacgtccaatacaacacacgcctaacataggaaactggaaggggacgtaccgtaaagactacgtcgaacgacgaccgggttaccgttttattaagttgtagaactaaagttaaagtaattcgaaactaacgttagttgttactttgataagttgggtacggggacgtaacggggctaacg

SEQ ID NO: 397776 - DNA, 609 bp, Homo sapiens
  misc_feature: GZ8MTXP01CHR7M.13.33.C11.1.454.CMB.2.raw
  modified_base (271)..(271): a, c, t, g, unknown or other
  modified_base (361)..(361): a, c, t, g, unknown or other
  modified_base (428)..(428): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagccgtggggcctcagtgaaggtctcctgcaagcctctggatacaccgtcaccgacgaccatanatacgtgggtgcgacgacggcccctaggacaaggccttaggagtggatgggacatatcacgccctgtcaggtgtacgaccagtaaagttnacaaacagtaacttgaggacgaggtacacatcgaccacggacacgtacataccaaacacagccctanagtaggaactagggaggggacgtaacccttaaaggacttacgacggaaccgtacgtaaccgggttccgttttaattagttcggtagtaactaaagttaaacggtaaattcggaaacctaaaggttattgttacgttttaagattaaggtaggggttacggggaacgtaacgggaactaacg

SEQ ID NO: 397777 - DNA, 613 bp, Homo sapiens
  misc_feature: GZ8MTXP01C0YEZ.13.33.C11.1.454.CMB.2.raw
  modified_base (347)..(347): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtcctcagttgtaatgtgtctggtgctcctaagtagactacttactacgtgggctggatccggcacgcccccgagggaagggcgtggagtggagttggggatatctcgttagtagtgggagtacgaactacgaatccgtcctnaagacgtcgagtcatcaatatccgtagacgaggtaccaaggaacgtaacttctaccctagaaacgtgtacgttctgtacgaccgtcgacagacacgcttgtcttatttaagttgtgacgagacggactaaaagtgtgggttacgaaggggtacgttaacggaacgttacggtcgggggacccgtaacggggtaaccccttggggttcccaacccggttcctcccgtccgtaacgccccgttacccgtaacccgaacggggtccccc

SEQ ID NO: 397778 - DNA, 542 bp, Homo sapiens
  misc_feature: GZ8MTXP01C4TIA.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgcccacaaaaagtttcgcacagtaactttcgaggacagggtcacatgacacgacacgtcatcaacacagcctacatggggaactgagacgacctaagatctagacgtacgaccggtcccgtttaattaattgttgacgaaataaaggtaattagcaaacgtaataggtcttttaggattagttggttggggtaacccgg

SEQ ID NO: 397779 - DNA, 570 bp, Homo sapiens
  misc_feature: GZ8MTXP01EDEC4.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactggggctggatccggcagcccccgagggaagggctgggagtggagttggggatatctcttagtagtgggagtacgaactacaatccgtccctacaagacgtcgagtcatcaaatactcgtagacaggtccaggaacgattctaccctagaaacgtgagttctgtacgaccgtcgcagacacggtctgtactatttattgtgcgagacggcaaaatgtggttcgaggggtagttcgaacttacggtgggggacccgacggggtaacccttgggttccaccggtctcctcacgcccttaccaaccgaacgggtcccc

SEQ ID NO: 397780 - DNA, 618 bp, Homo sapiens
  misc_feature: GZ8MTXP01BGXI6.13.33.C11.1.454.CMB.2.raw
  modified_base (271)..(271): a, c, t, g, unknown or other
  modified_base (438)..(438): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagccgtggggcctcagtgaaggtctcctgcaagacctctggataccaccgtcaccgacgaccatanatactgggtgcgacacggcccctggacaaggccttgagtggatgggacatatcagccctgtcgaggtcggtcgaccaacgtaaagtttcgaccaaacgaacgtaactttcgagggacacggggtccacatacgaccacggacacgtccaatacaaacacacgcctanagtacggaactggaggggacgaccgtaaagactacgtacgaccgaacgtaccgggttcctttaagttagttgtacgaactaaagttaaagtaattaggaaacctaaaagttcgttggttacttttaaggaagtttaaggtacggggttacggggaacccggtaaggggttaaccctaagg

SEQ ID NO: 397781 - DNA, 580 bp, Homo sapiens
  misc_feature: GZ8MTXP01BTRI9.13.33.C11.1.454.CMB.2.raw
  modified_base (250)..(250): a, c, t, g, unknown or other
  modified_base (550)..(550): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctgagtgaaggtctcctgcaagacctntggatacaccgtcaccgacgaccatatatacgtgggtgcgacacggcccctggacaggccttgagtggatgggacatatcagccctgtccaggtggtcgacccacgtaaaaagtttcgcaacgaagtaactttcgaaggacacgggtacactatcgaccaggaccacgtaccatacaacacacgcctaacagtacggggaactggacggacgtacctaaagctacgtacgaccgtaccgtaccgggtaccgttttaattaagttgttagtaacttaaagtaaagtaattcgacaaacgtntagtctttagattacgtggttcggggaacg

SEQ ID NO: 397782 - DNA, 748 bp, Homo sapiens
  misc_feature: GZ8MTXP01D1LYO.13.33.C11.1.454.CMB.2.raw
  modified_base (248)..(248): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtgggctgaggtgaagaagccgtggggcctgagtgaaggtctctgcaagcctntggatacaccgtcaccgacgaccatatatacgtgggtgccgacgacggcccctaggacaaggtccttaggaggtggagtgggactatactcacgccctgtcccgaggtggtcgaccctaacgtaaaaaagtttcgaaccgtaaacgtaaacggttaaacccgttttcgaaacggggtaccgggtaaacgggggttacccaaacccgtaagttacccggaaaccccgaaccgggaaccctaacccggttaccccaaacttaacccgaaaacccgaaccaaccgtaacccttaaaccgtaaggttaacggggggaaaaccgttaggggaaacgggaacggtaacccttaaaggacttacggtacggaaccggaaccgttaccgggttaaccgttttaattaacgtttgggttaacgtaacttaaaagtaaaggtaactttacgaacgttaaacgaagtttcgtaacgttttaggaagttaggtcggggttaacgggaaccgg

SEQ ID NO: 397783 - DNA, 556 bp, Homo sapiens
  misc_feature: GZ8MTXP01DUDW6.13.33.C11.1.454.CMB.2.raw
  modified_base (351)..(351): a, c, t, g, unknown or other
  modified_base (514)..(514): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagcctgggggcctcagtgaaggtctcctgcaagacctctggatacaccgtcaccgacgaccatatatacgtgggtgacgacgacggccccctggacaaaggccttgagtggatgggacatatcagccctgtcagtgtcgaccanaaagttgacaaacagtaacttgaggacagggtacacatcgaccacggacacgtcatacaacacagcctaacagtagaactaggaggggaacgacctaaagatacagaccgactacggtcctttattattgtcgaataaattaaagtaattagaactaaagttnttgttattttaagattaagtggtagggacgtaacggcgtaac

SEQ ID NO: 397784 - DNA, 589 bp, Homo sapiens
  misc_feature: GZ8MTXP01BRY7O.13.33.C11.1.454.CMB.2.raw
  modified_base (544)..(544): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatacgtgggtgcgacacggcccctaggacaaggccttggagtggatgggacagtatcagccctgtcaggtcggtcgaccaacgtaaagtttcgacaaacgaagtaactttcgaagggacaggggtaccaaccagtacgacccacggacacgtccatacaacacacgcctacatacggaactggaggggacgaccgtaaagacttcgagaccgaccgtaacgggtccgtttattagttgtagtaactaaattaaaggtaattagaactaaacggnttagttcttttaagattaagtggtacggggacaagggaactaacg

SEQ ID NO: 397785 - DNA, 615 bp, Homo sapiens
  misc_feature: GZ8MTXP01AKLQL.13.33.C11.1.454.CMB.2.raw
  modified_base (424)..(424): a, c, t, g, unknown or other
  modified_base (448)..(448): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggacgaccctgtccctcagttgtaatgtgtctggtgctacctaagtagactacttactacgtgggactggactccggcacggcccccgagggaacgggctggagtggagttggggatatctacttagtaggtggagtacgaactacactccgtacctacgaagtacgtcgagtcatcaatactcgtagacgaggtacaggaactattcctacctagaaagtgagttccngtacgaccgtcgcacgacacggtntacggtacttagttagttgtcgtacgagacggactaaaagtgttggttacgagggtacgttcgacgttacggtcggggcccgtaacggggtaacccttcggttaccttacccggtcctacccggttcaacccggtcccttacccgaacccggttaaccggtcccccg

SEQ ID NO: 397786 - DNA, 554 bp, Homo sapiens
  misc_feature: GZ8MTXP01DQ17N.13.33.C11.1.454.CMB.2.raw
  modified_base (473)..(473): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaagggctggagtggattggggatatctcttatagtgggagtacgaactacaaatccgtcctcaagacgtcgagtcatcaatatcgtagacaggtccaaggaacgaattctaccctagaaacgtgagttctgtagaccgtcgcagacacgctgtctatttatgtgcgtagacggcaaatgtggtacagggngttcgacttaacgttggggacccgtaacgggaacccttgggccacccggtctcctcgacgcccttcaacccgaagggcccc

SEQ ID NO: 397787 - DNA, 689 bp, Homo sapiens
  misc_feature: GZ8MTXP01ENUBY.13.33.C11.1.454.CMB.2.raw
  modified_base (211)..(211): a, c, t, g, unknown or other
  modified_base (412)..(412): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctnagttgtaatgtgtctggtgctccctaagtagactacttactactgggctggatccggcagcccccgagggaagggctggagtggattggggatatctcttatagtgggagtacgaactacaatcctccacaagacgtcgagtcatcaatactcgtagacaggtaccaaggaacgaacttcaccctagaaacgtgaagttcngtacgaaccgttgacagtacaacggtctacggttacttaagtttagtttagtacggaccggtaaggaacccggtacgtaaaaagttcgttaggggtttaccggaaagggggtgtttaacccgggtaaacgttaacgggtacggggggttaccccgtaaacgggggtaacccccgtttagggggttccccttaaaccccgggttcccgttccccttaacccgaacccggggtccccttacccccggtaaaccccgaaacccgggggttaacccccccg

SEQ ID NO: 397788 - DNA, 521 bp, Homo sapiens
  misc_feature: GZ8MTXP01EC3VH.13.33.C11.1.454.CMB.2.raw
  modified_base (280)..(280): a, c, t, g, unknown or other
  modified_base (363)..(363): a, c, t, g, unknown or other
  modified_base (466)..(466): a, c, t, g, unknown or other
  modified_base (482)..(482): a, c, t, g, unknown or other
  modified_base (488)..(488): a, c, t, g, unknown or other
  modified_base (492)..(492): a, c, t, g, unknown or other
  modified_base (516)..(516): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtncgacaggcccctggacaaggccttgagtgatgggacatatcagccctgtcagtggtcgccacaaagtttgcaacagtaacttnaaggacagggtcacatcgaccacggacacgtcatcaacacagcctacatggaactgaggggagacctaagatcgtgacgacacggtcctttaattattggtcnaaattaagtaattganaaacgnttgntttaagataatggtgggcaagggntaacg

SEQ ID NO: 397789 - DNA, 547 bp, Homo sapiens
  misc_feature: GZ8MTXP01DT3CY.13.33.C11.1.454.CMB.2.raw
  modified_base (519)..(519): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctctgcaagacctctggatacaccgtcaccgacgaccatatatacgtgggtgcgacaggcccctggacaaggccttgagtggatgggacatatcagccctgtccagtggtgccactaaaagtttgcacagtaactttcaggacagggtcacatcgacacggacacgtaccatacaacacacgacctaacacgtaggggaaactggaaggacgacctaagactcgtagacgtacgtacggtcctttaataattgttgacttaaagtaaagtaattaggacaaaggtntagtctttgattagtggttcgggaaccg

SEQ ID NO: 397790 - DNA, 659 bp, Homo sapiens
  misc_feature: GZ8MTXP01EKGAY.13.33.C11.1.454.CMB.2.raw
  modified_base (269)..(269): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctcctgcaagacctctggatacaccgtcaccgacgaccatanatactgggtgcgacacggcccctggacaaggccttgagtggatgggacatatcacgccctgtcagtggtcgaccaacgtaaagtttgacaaacgaagtaactttcgaaggacagggtacaccatcgaccacggacacgtcatacaaacacacgacctaacagtacggaaactggaacggggaacgtacccgtaaagacttaccgtaacggaaccggaaccgtaaccggggttaccgttttaaatttaacgtttacggtaaggtaaacctaaaagtttaaaacggtaaattttacggaaaccctaaaacgggttagtttcgttacgtttttaagggtaattaacggttgggggttaacgggggacccgtaaaagggggttaactaaaccgg

SEQ ID NO: 397791 - DNA, 719 bp, Homo sapiens
  misc_feature: GZ8MTXP01A9MC5.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcagtgaaggtctcctgcaagacctctggactacaccgtcaccgacgaccatatatacgtgggtcgcgacgacggccccctggaacaaggccttggagtggatgggacatactcacgccctgtccaggtggtcgaccaacgtaaaagtttcgcctaaacgacgtaaaccgttttcgaacgggtaaccgacggggttacccaaccgtaacgttaccgggaaccccgaaaccggggaaccctaacccgggtttaccccaaacgttaacccaaaaccgaaccaacggacccttaacgaacgttaacgggggaaacgttagggaacggaacgtacccgtaaagacgttaccgtaacgaccgtaaccggtaccgggttacccgttttaagttaagttcggttagaaaccgttaaagtaaaacggtaatttacggaaccgttaaaacgtaagttaggttcttttaaggaagtttacgtaaggggttaacggggtaaccggg

SEQ ID NO: 397792 - DNA, 610 bp, Homo sapiens
  misc_feature: GZ8MTXP01EMMRI.13.33.C11.1.454.CMB.2.raw
  modified_base (344)..(344): a, c, t, g, unknown or other
  modified_base (424)..(424): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggataccaccgtcaccgacgaccatatatactgggtgacgacacggcccccgtggacaaggccttgagtggatgggacatatcagccctgtcagtggtcnccaacaaagttgacaaacagtaactttcaggacagggtacacatcgaccacggacacgtccatacaaacacacgcctaanacgtaggaaactggaagggggacgaaccgttaaagacttacacggaaccgtaccgacgggttccgtttaattagttagtagaactaaagttaaaggtaaatttacgaacgtaaaacgttgttcgttacgtttttaaggaagttaacgttaggggtacgggggacccgtaaaggggttaacctaacg

SEQ ID NO: 397793 - DNA, 741 bp, Homo sapiens
  misc_feature: GZ8MTXP01ET4QD.13.33.C11.1.454.CMB.2.raw
  modified_base (225)..(225): a, c, t, g, unknown or other
  modified_base (249)..(249): a, c, t, g, unknown or other
  modified_base (692)..(692): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtgggcctnagtgaaggtctctgacaagacctntggataccaccgtcaccgacgacatatatacgtgggtgcgacgacggccccgtagggaacaacgggtccttaggaaggtggagtacgggaactagtatcacgtcccgtgtcccgaggtggtacgaccctaacgttaaaaaaggtttcgaaccgtaaacgtaaacggttaaaccgttttacgaaacggggtaaccgtaacgggggttacccaacccgtaagtaccggaaaccccgaaccggggaaacctaacccggttaacccaaacgttaacccgaaaaccgaccaaaccggaacccttaaacgaacgttaacggggggaaaccttaggggaaacggaacgtaacccgtaaagacgtacgtacggaaccgtaaccgtaccggttaccgttttaattaagtttgacgtaattaaagtaaaggtaattacgaaccgaaaacgttntacggttaacgttttaggaagttaggtaacgggttaacgggggaaaccg

SEQ ID NO: 397794 - DNA, 603 bp, Homo sapiens
  misc_feature: GZ8MTXP01CMVV8.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagaagcctggggcctcagtgaaggtctcctgcaagacctctggataccaccgtcaccgacgaccatatatacgtgggtgcgacaggcccctggacaaggcctagagtggagtgggacatatcacgccctgtccaggtggtcgaccaactaaaagtttcgcacaacgtactttcgaggacgtacgggtacaccagtacgaccgacggacacgtaccatacaacacacgacctacagtacggggaactaggacggaacgacccgtaagactacgtacgacgtaccgaccgggttaccgtttattaagttgttaggtaaccttaaagttaaagtaatttacggacgttaaacgtaagtagttcgttttagagttagttcgggttaacggggtaacccgg

SEQ ID NO: 397795 - DNA, 590 bp, Homo sapiens
  misc_feature: GZ8MTXP01BZSSX.13.33.C11.1.454.CMB.2.raw
  modified_base (222)..(222): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctnagtgaaggtctcctgcaagacctctggactaccaccgtcaccgacgaccatatatacgtgggtgcgacacggcccctggacaaggccttgagtggagtgggacatatcacgtccctgtcaggtcggtcgaccaactaaagtttcgacaaacaagtaactttcgaagggaccgagggtccaacagtcgacccgacgacacgtaccataccaaacacacgccctaacagtacggaactggaacggggacgtaccgtaagactcgtacgacgacgtaccggtcgtttattagttgagtaactaaagttaagtattagaactaaagttgttgttctttaagagttaagtgggtacgggacgtaagggctaag

SEQ ID NO: 397796 - DNA, 585 bp, Homo sapiens
  misc_feature: GZ8MTXP01BDB3D.13.33.C11.1.454.CMB.2.raw
  modified_base (448)..(448): a, c, t, g, unknown or other
  modified_base (549)..(549): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtggggcctcgagtgaaggtctctgcaagacctctggatacaccgtcaccgacgacatatatacgtgggtgcgacacggcccctaggacaaggccttgagtggagtgggacatatcgacgccctgtcccgaggtggtacgccaacgtaaaagttcgaacacgaagtaactttcgaggtacgacgggtcaccatcgaaccgacggacaccgtaccatacaacacacgacctanacgtagggaactaggagacgacctaagctcgtagaccgacgtacggttaccgtttagttaattggttagtacaaagtaaagtaattcgacttaaaacggtntagttaacgtttagattaggtgggttaacgggaacg

SEQ ID NO: 397797 - DNA, 637 bp, Homo sapiens
  misc_feature: GZ8MTXP01CJAFF.13.33.C11.1.454.CMB.2.raw
  modified_base (487)..(487): a, c, t, g, unknown or other
  modified_base (597)..(597): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggacgaccctgtccctcagttgtaatgtgtctggtgctccctaagtagactacttactacgtgggctggatccggcacgccccgagggacgggctggagtggagttggggattagtctcttagtacgtgggtaagtacgaaactacaaacttcccgtaccctacgaagtaccggtcgagtccaagtaccaaattaacgtcccggttaagaaccgacgggttacccaagggaacggtaaacttccctacccgtagaaagttgagttcctggtacgaccgtgcgagacgacggntcgttacttattagttgtagacgagaccggataaagtagttcgggtacagggtcgttaacgacgttacgggtcggggcctaacggggaccttcggttccaccggttcccncgttcgacccgtccttacccgaacccgttaacgggtcccc

SEQ ID NO: 397798 - DNA, 565 bp, Homo sapiens
  misc_feature: GZ8MTXP01ERB19.13.33.C11.1.454.CMB.2.raw
  modified_base (225)..(225): a, c, t, g, unknown or other
  modified_base (442)..(442): a, c, t, g, unknown or other
  modified_base (536)..(536): a, c, t, g, unknown or other
  modified_base (541)..(541): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtctggggctgaggtgaagagccgtggggcctnagtgaaggtctcctgcaagacctctggatacaccgtcaccgacgaccatatatacgtgggtgcgacacggcccctggacaaggccttgagtggatgggacagtatcacgtccctgtcccgaggtggtcgacctaactaaaagtttgctacgaagtaacctttcgaagggacgagggtcacatacgaccacggacacgtacatacaacacagcctaanagtacgggaactggagtacgacctaagactcgtagacgtacgtacggtccgtttaataagttgttgacttaaagtaagtaattagacttaagtntcgtnttttagattagtcggttgggaacg

SEQ ID NO: 397799 - DNA, 657 bp, Homo sapiens
  misc_feature: GZ8MTXP01BTVSJ.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgtaatgtgtctggtgctcctaagtagactacttactacgtgggctggactccggcacgcccccgagggaacgggctggagtggagttggggatatcgtcgttagtaggtagggtagtaacgaactacaactccgtacctacaagtacgtcgagtcatcaaatactccgtagacaggtccaaggaacacttcacctagaaacgtgtagttctgtacgaccgtgacagaccacggtcttcgtacttagtttaagttcggtacgtacggtaaaggaacccggtactaaaaagttcgttacgggttaccgaaggggtacgttccggtaacgttaccgggtcgggggttacccgtaaacggggtaaccccgttcgggttacccgaccccggttctacccgttaaccgaccggtccccttacccggaacccgttaaccggggtcccccg

SEQ ID NO: 397800 - DNA, 631 bp, Homo sapiens
  misc_feature: GZ8MTXP01DOHEB.13.33.C11.1.454.CMB.2.raw
  modified_base (230)..(230): a, c, t, g, unknown or other
  modified_base (237)..(237): a, c, t, g, unknown or other
  modified_base (553)..(553): a, c, t, g, unknown or other
  modified_base (589)..(589): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgagtgagaagcgtgggcgtcagtgagtntctgcanactctgatacaccgtcaccgacgaccatatatacgtgggtgcgacgacggccccgtggacgaaggcccgttgaggtaggtagtagggtacacttatccgacgcccgtcgtccgaggtagggtgcccaactaaaaagtttgcgaactaagtaaacctttcgaacggacgagggtaccaccatacgaccacggacacgtcaactacaacacacgcctaacacgttaggggaaacctagggaacgggaacgtaccctaagtacgtacgtacggaaccgtaaccgtaccggttaccgtttttaatttaagtttcggttanaaacttaaagtaaagtaacgtttagacaaaacggtntttagtctttttaaggattagttaaggggttggggtaaccgg

SEQ ID NO: 397801 - DNA, 594 bp, Homo sapiens
  misc_feature: GZ8MTXP01B57WL.13.33.C11.1.454.CMB.2.raw
  modified_base (248)..(248): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctntggatacaccgtcaccgacgaccatatatacgtgggtgcgacacggcccctggacaaggccttgagtggatgggacagtatcagccctgtcccaggtggtgccaacgtaaaaagtttcgcaacagtaactttcgaaggtacgagggtcaccatacgaccgacggacacgtaccactacaaacacacgccctaacagttacgggggaaacttggaacgggtaacgaccctaaagacgtctacggaaccgtacgtacgggtccgtttaattaagttgttagtacaaagtaaacgtaattcgacttaaacgtaattggtaactttagattagtgggttcggggtaaccg

SEQ ID NO: 397802 - DNA, 658 bp, Homo sapiens
  misc_feature: GZ8MTXP01DGUXF.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggccaggagtggtgaagccttcggagaccctgtcctcagttgtaatgtgtctggtggctacctaagtaggactacttactacgtgggctggactccggcacgcccccgagggaacgggctggaggtggagttggggatagtctacttagtaggtgggagtaacgaactacaacgtccgtaccctacgaagacgtacgagtcatacaaatactccgtagacacggtaccaaggaacgattctacctagaaaggtgtagttcgtgtacgtaccgtcgcgaacgacgacggtccttagttacttagtttaagtttggagacccggtaagtacccgggaactaaaagttaggtgtttacgaaggggtgttaacgtaacgttacggtacgggggaccgaaacggggtaacccgttgggttccttaacccgggttcctcccggttaacctaccggtccccttacccgtaacccggaaacggggtaacccccg

SEQ ID NO: 397803 - DNA, 665 bp, Homo sapiens
  misc_feature: GZ8MTXP01A1ZME.13.33.C11.1.454.CMB.2.raw
  modified_base (498)..(498): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtagaagagccgtgggcctgagtgaggtctctgacaagcctgtggactacaccgtcaccgacgaccatatatacgtgggtgcgacgacggccccgtggaaccaagggtcccttaggaggtgggaagttggggactatactcacggtccctgtcccgaggtggtcgacctaacgtaaaaaaggtttcgaactaacgaaacgtaaaccgttttacgaacgggtacgacggggttacccaccgtagtaccgacccgaacggacctaccgtaccactacaacacgacgacctaanagttacggggaacgtaggaacggacgaacttaagactcgtacgacgtaacgtaccggttacctttaagttaacgttgttaccgtaaagttaagtaaagttacgttaacgaacgttacgttaagttcgtttaagttagttagttaggtcggggttaacggtaaccggg

SEQ ID NO: 397804 - DNA, 556 bp, Homo sapiens
  misc_feature: GZ8MTXP01DXX93.13.33.C11.1.454.CMB.2.raw
  modified_base (522)..(522): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagccgtggggcctcagtgaaggtctcctgcaagacctctggatacaccgtcaccgacgaccatatatactgggtgcgacacggcccctggacaggccttgagtggatgggacatatcagcctgtccaggtgtgccactaaaagtttgcacagtaactttcgaggacgagggtcaccatcgaccacggacacgtaccatacaacacagcctacagtacggggaactggaggacgacctaagtctctacgacgtacgtacggtccgtttattaagttgttagtacttaaagtaagtaattacgacaaacggtntagttcttttagattagtgggttcgggtaaccgg

SEQ ID NO: 397805 - DNA, 533 bp, Homo sapiens
  misc_feature: GZ8MTXP01A2DJC.13.33.C11.1.454.CMB.2.raw
  modified_base (287)..(287): a, c, t, g, unknown or other
  modified_base (475)..(475): a, c, t, g, unknown or other
  modified_base (505)..(505): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactgggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatacgtgggtncgacacggcccctggacaaggccttgagtggatgggacatatcagccctgtccagtggtgccaacaaaagtttgcacagaactttcgaggacagggtcacatgaccacggacacgtccataccaacacagcctacatacggggaactggaggacgacctaagatctagacgacacggtccgtttattntgttgacaaagtaaagaattgacaaacgtntgtcttttgattagtgggttgggaaccg

SEQ ID NO: 397806 - DNA, 563 bp, Homo sapiens
  misc_feature: GZ8MTXP01C4AGB.13.33.C11.1.454.CMB.2.raw
  modified_base (343)..(343): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactgggctggatccggcacgcccccgagggaagggctggagtggattggggatatctcttatagtgggagtacgaactacatccgtcctnaagacgtcgagtcatcaaatatccgtagacaggtccaggaacatctcctagaaagtgagttctgtgaccgtcgcagacacggctgtcttattattgtgcgagacggctaaaatgttggttacaggggtagttcgacgttacgtcgggggccaacggggtaacccttgggttccacccggttctcccgtcacggcccttacccgaaccgaacggggtcccc

SEQ ID NO: 397807 - DNA, 619 bp, Homo sapiens
  misc_feature: GZ8MTXP01COZB6.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagcctggggcctcagtgaaggtctcctgcaagacctctggatacaccgtcaccgacgaccatatatacgtgggtgacgacacggcccctggacaaggccttaggagtggatgggaacatatcagccctgtcccaggtggtcgacccaacgtaaaaagtttgccaaacgtaaggtaaaccttttacgaacgggtaacgaacggggtaccaccagtacggaacccgaacgggacaccggtaccactacaaacacacgacctacagtagggaactggaacggagaccgtaagactacgtagaccgtaacgtaccggtcctttagtaatttgcgtacaaagtaaaggtaatttagacgttaaacgtaagtacgttaacgttttagagttagttgggttaacggggtaacccg

SEQ ID NO: 397808 - DNA, 584 bp, Homo sapiens
  misc_feature: GZ8MTXP01DUYKR.13.33.C11.1.454.CMB.2.raw
  modified_base (248)..(248): a, c, t, g, unknown or other
  modified_base (364)..(364): a, c, t, g, unknown or other
  modified_base (546)..(546): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctntggatacaccgtcaccgacgaccatatatacgtgggtgcgacacggcccctggacaaggccttgagtggatgggacatatcagccctgtccaggtgtcgccaagtaaaagttgcanagtaacttcgaggacgagggtccacagtcgaccgacggacacgtaccatacaacacacgcctaacagtacgggggaactaggaacggacgacgtaaagctcgtaacggaccgtaacgtaccggttaccggtttattaacttgttagaacgttaaagtaaaggtaattacgacgttaaacgtnttagtcgttttagagttagttcgggaacgggtaaccgg

SEQ ID NO: 397809 - DNA, 620 bp, Homo sapiens
  misc_feature: GZ8MTXP01BB9BZ.13.33.C11.1.454.CMB.2.raw
  modified_base (199)..(199): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcggccccggganagacggccacaattccctgtgaagggaaacaaccttagaagtcaagaatgtccactggaccagcagaagtcaggccaggcccctggtggtggtcatctagtagggataacgtaacccggccctacgtcgggactcccgtgaccgtattctcgtggcctaccccgaacgtcggggaaccaccggcccaaccctcgaaccataccgaaacacgacgacccgaaggacggggatggacggctagacttagttagttgtcgagggtgtaggacagccacggacggtgagtacgtcgggcggcggaccaacggcgtcggaccgtccgtaggtccacggcccgaacggccgtacccggcccccgttcgggttccttaccgttcccgtccgttccccgcccttccgttaccgtaacgttccgtaacgg

SEQ ID NO: 397810 - DNA, 539 bp, Homo sapiens
  misc_feature: GZ8MTXP01D3XFR.13.33.C11.1.454.CMB.2.raw
  modified_base (322)..(322): a, c, t, g, unknown or other
  modified_base (422)..(422): a, c, t, g, unknown or other
  modified_base (443)..(443): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgagacaggcccctggacaaggccttgagtggatggganatatcacgccctgtccaggtggtgaccactaaaaagtttgcgacagtaaactttcaggacagggtcaccatcgacacgacacgtcatacaacacagctanatggggaactgagagctaagnttcagacgtacacggtccgtttataattgttagtacttaaataaagaattaggcttaaacgtaataggtctttagattagtggttcggggtaaccg

SEQ ID NO: 397811 - DNA, 552 bp, Homo sapiens
  misc_feature: GZ8MTXP01CSVPD.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggagtgggacatatcagccctgtccaggtggtgccactaaaagtttgcacagaactttcaggacagggtcacatgacacggacacgtaccatacaacacagacctacatcggggaactggaggagccgtaagatctacgacgaacgacggtccgtttaattaattgttgtacaaagttaaagaatttacggacttaaacggtaataggtctttagaagttatggttcggggaacccggg

SEQ ID NO: 397812 - DNA, 608 bp, Homo sapiens
  misc_feature: GZ8MTXP01CTS7K.13.33.C11.1.454.CMB.2.raw
  modified_base (249)..(249): a, c, t, g, unknown or other
  modified_base (570)..(570): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcagtgaaggtctctgcaagactcnggatacaccgtcaccgacgaccatatatacgtgggtcgcgacacggcccctaggacaagccgttgagtggagtgggacatatcgacgcctgtccgaggtggtgaccaacgtaaagttcgcaactagtaacttcgaaggacacgggtcacagtcgaccgacggaccacgtacactacaaacacacgcctaacgacgttagggggaaacctggaaacggacgtaaccctaaagacgtacgtacgaaccgtaaccgtacgggtaccgttttaattaacgtggttacgacttaaagttaaacgtaattacggaacttaaacggtntagtttaacgtttgagttacgtgggttcgggtaaccgg

SEQ ID NO: 397813 - DNA, 583 bp, Homo sapiens
  misc_feature: GZ8MTXP01E0YI5.13.33.C11.1.454.CMB.2.raw
  modified_base (247)..(247): a, c, t, g, unknown or other
  modified_base (444)..(444): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagccgtgggcctcagtgaaggtctcctgcaagacctntgatacaccgtcaccgacgaccatatatacgtgggtgcgacacggcccctaggacaaggccttgagtggatgggacagtatcgacgccctgtcccgaggtggtacgccaacgtaaaagtttcgaacaacgtaagtaacttcgaaggacgagggtacacatacgacacggacacgtaccactacaacacacgacctanacgtagggaacgtaggaaggacgactaaacgatacgacgaacgacgtaccggtaccgtttattaagttagttagtacttaaagtaaagtaattagaccaagtaatcgttaatttagagttagtggttaacgggaaccgg

SEQ ID NO: 397814 - DNA, 640 bp, Homo sapiens
  misc_feature: GZ8MTXP01D4XCI.13.33.C11.1.454.CMB.2.raw
  modified_base (497)..(497): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagcgtggtgcagtcgtggggctggaggtgaagagccgtgggcctcgagtgaggtctctgacaagcctcgtgactacaccgtcaccgacgaccatatatacgtgggtcgaccgacgaccggacccccgtaggaaccgaacgggtccgttaggaggtggaagtcgggaactagttactacgacgtcccgtgtaccccgaggttcggtacgacccgtaaacgttaaaagtttcgcaaacgtaaacgtacctttacgaacgggtacgacgggtaccacgatacgaccgacggacacgtacactacaacacacgacctanagtagggaactaggaacgacgacgtaagctacgtacgaacgtacgtacggttctttaattaagttgttacgaattaaagtaaagtacttagacttaaagtaattgttaacgtttagagttaggtaacgggttaacgggaaccg

SEQ ID NO: 397815 - DNA, 638 bp, Homo sapiens
  misc_feature: GZ8MTXP01DGF9S.13.33.C11.1.454.CMB.2.raw
  modified_base (244)..(244): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcagtgaaggtctctgcaagcctntggatacaccgtcaccgacgaaccatatatacgtgggtgcgacgacggccccgtggacaaggccttgagtggagtgggacatatcgacgtccctgtcaggtggtccgaccaataaagtttgacaaacaagtaactttacgaacgggacgagggtaccaccagtaccgaaccgacgggaaccaccgtaccataccaaacaacgacgacctaacgagtacggaacgtaggaagggggacgtaacccgtaaagtactcgtacgaccgtacgtaaccggttaccgttttaattagttcgtagtaactaaagttaaaggtaaattcggaaactaaacgttagttgttacttttggtaagttcgttaggggtacgggttaaacggtaacggaacgtaacg

SEQ ID NO: 397816 - DNA, 715 bp, Homo sapiens
  misc_feature: GZ8MTXP01BYIGH.13.33.C11.1.454.CMB.2.raw
  modified_base (597)..(597): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagagccgtggggcctgagtgaaggtctcctgacaagacctcgtggactaccaccgtcaccgacgaccatatatacgtggtgcgacacggcccctggaacgaaggccttagaggtaggagtagggacagtactcgacgtcccgtgtaccgaggtcggtccgaccctaaacgttaaaggttcgacctaaaacgtaacgttaactttcggaaacggaaccgtacggggtacaacccgaataccgaacccgaacggaacctaaccggtacccaactacaaacccgacaacgtaccctaacagtacggaaactaggaggggaacggtaaccttaaagacgttacgaacggaaccgtaccggtaaccgggtttcccttttaaagttacgtttacggngtaaaaccgtaaaagttaaagggtaaacctttaggaaaacccgtaaaggttaacgtttcgttaacgttttaagaacgttgtacggggttacgggaaccgtaaaggggttaactaaccg

SEQ ID NO: 397817 - DNA, 749 bp, Homo sapiens
  misc_feature: GZ8MTXP01EVDNB.13.33.C11.1.454.CMB.2.raw
  modified_base (226)..(226): a, c, t, g, unknown or other
  modified_base (245)..(245): a, c, t, g, unknown or other
  modified_base (283)..(283): a, c, t, g, unknown or other
  modified_base (309)..(309): a, c, t, g, unknown or other
  modified_base (322)..(322): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagccgtggggcctnagtgagtctctgcagcctnggatacaccgtcaccgacgaccatatatacgtgggtcncgacacggcccctggacaggctgagnggagtgggactanatcacgccctgtccaggttggcgaccctaaacgtaaaaacggtttcgccgtaaacgtaagttaaacccttttacgaaccggggtaaccgaacgggggttacccaacccgtaagtaccggaacccgaaccgggaaccctaccggttacccaaactaacccaaacccgacgaaccgtaccctaaacgtaacgtaacgggggtaaaccgttaaggggtaacggaaccggtaacccgtaaacgtaccgttacggtaaccggtaaaccgtaacccggttaacccggtttacccgttttaagtttaacgtttacggttacggtaaacttaaacgttaaaagtaaacgtttacggaaacccgttaaaacggtaagttaggtttaaccgtttttaggaagttacgggttaacggggttaacggggtaaacccggg

SEQ ID NO: 397818 - DNA, 747 bp, Homo sapiens
  misc_feature: GZ8MTXP01CBVZL.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtagaagaagccgtggggcctcgagtgaacggtctccgtgacaagacctgtggactaccgaccgtcaccgacgaccatatatacgtgggtcgcgacgacggccccgtaggacaacggtccgttaggaggtggagtcgggaactagtactcgacgtcccgttggtacccgaggttgggtacgaccctaaacgttaaaaacggtttcgaacacgtaaagttaacctttacgaacgggtacgtacgggtacccaactaacggtacgaacccgaaccggaacgtaacccgtaccctaactaaccaaaccgaaccgacgtaacccttaacgaacggttacggggaaaccgtagggaaacggtaacgtaccgtaaacgcgttacgtaccgaaccgtaccgttaaccgggtttacccttttaagttaacgttacggttagtaaaccttaaaagttaaacggtaacgtttaacggaacttaaaacggtaattacggtttaacgttttaggaagtttagggtaaccggggttaacggggtaaacccggg

SEQ ID NO: 397819 - DNA, 745 bp, Homo sapiens
  misc_feature: GZ8MTXP01ANGMZ.13.33.C11.1.454.CMB.2.raw
  modified_base (252)..(252): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtagaagagccgtggggcctcgagtgaaggtctctgcaagacctntggactacaccgtcaccgacgaccatatatacgtgggtgccgacgacggccccgtaggacaacggccttaggaggtgggtagtgggaacagtactcgacgccctgtccaggtggtacgacccaacgttaaaaaggtttcgccgtaaacgtaacgtaaaccgtttacgaacgggtaccgtaacggggttacccaaaccgtacgttaccggaacccgaaccggggaccctaacccggtacctaaacttacccgaaaccaacccgaaccgtaccctaacgtaacggttaaccgggggaaacgttagggaaacgggaaccgtaaccgtaaacgtacgtttaccgaaccggtaaccgtaaccggtaacccgggttaccttttaaagttaacgttacggttaggttaaccaaaagtaaaggttaacttacggaaccgaaacgtttaattcggtttaacttttaggagttaggttaacggggttaacggggaaacccggg

SEQ ID NO: 397820 - DNA, 610 bp, Homo sapiens
  misc_feature: GZ8MTXP01BGUL9.13.33.C11.1.454.CMB.2.raw
  modified_base (286)..(286): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatacgtgggtncgacacggcccctggacaaggccttgaggtggatgggacatatcagccctgtccaggtggtcaccaacgtaaaagtttcgcacaagtaactttcgaggacacgggtcaccgatacgaccacggacacgtaccataccaacacacgacctacacgttacgggggaactaggaacgggacgaccgtaaacgacttaccgtaggaaccgaaccgtaaccgggttaccgttttaagttaacgtttgttacggtaacttaaagttaaacggtaattacgacttaaaacgtgtagttcgttttagagttacgtgggttcggggaacccgg

SEQ ID NO: 397821 - DNA, 590 bp, Homo sapiens
  misc_feature: GZ8MTXP01AKYL3.13.33.C11.1.454.CMB.2.raw
  modified_base (351)..(351): a, c, t, g, unknown or other
  modified_base (428)..(428): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggacgaccctgtccctctagttgtaatgtgtcgtggtgctacctaagtagactacttactacgtgggctggatccggcacgcccccgagggaagggctggagtggagttggggatatctcttagtagtgggagtacgaactacgactccgtacctnaagacgtcgagtcatcaaatactccgtagacaggtaccaaggaacaacttcctccctaagtaaacgtgtaacgttcnggtacgaccgtcgacgagaccgacggtctgtacttattagttgtgtacgagacggactaaagttgtggtacgagggtagttccgaagttcggtcggggaccgacgggtaacccttggttccaccgttctcctcgacgcccttaccaaccgttaacggccccg

SEQ ID NO: 397822 - DNA, 603 bp, Homo sapiens
  misc_feature: GZ8MTXP01BWRWT.13.33.C11.1.454.CMB.2.raw
  modified_base (251)..(251): a, c, t, g, unknown or other
  modified_base (337)..(337): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagccgtgggcctcgagtgaaggtctcctgacaagacctntggataccaccgtcaccgacgaccatatatacgtgggtgcgacacggcccctaggaccaaggccttagagtggagtgggacagtancgacgccctgtcccaggtggtcgaccaactaaaagtttcgcaacgaagtaacctttacgaggtacgagggtaccacgtacgtacgacccgacggaccacgtaccataaccaacacgacgacctaacaacgtacggggaactaggaacggtacgacctaagactcgtacgaccgtacgacggttcctttaattaacgttgagtacaaagtaaacgtattacgacaaacgtaatcgtaagtttagagttagtgggttaacggaaccgg

SEQ ID NO: 397823 - DNA, 639 bp, Homo sapiens
  misc_feature: GZ8MTXP01AEB5U.13.33.C11.1.454.CMB.2.raw
  modified_base (219)..(219): a, c, t, g, unknown or other
  modified_base (243)..(243): a, c, t, g, unknown or other
  modified_base (271)..(271): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctnagtgaaggtctcctgcaagacctntggatacaccgtcaaccgacgaccatanatactgggtgcgacacggcccctggacaaggccttgagtggatgggacatatcagccctgtcagtggtcgccacgtaaagtttgacaacagaactttcgaggacacgggtcacatcgaccacggacacgtccatcaaacacacgacctaacagtacggaactacggacggggaacgacccgtaaggaactaccgtacgaacgaaccgtaccggtacccgttttaagttagtttaggttcggtaactaaagttaaacgtaaagtttacgaaaccgtaaaaccggttacgttacggttacgtttttaaggaaacgtttaagttacggggttacgggggaccccgtaaagggggttaaccttaaacccggg

SEQ ID NO: 397824 - DNA, 630 bp, Homo sapiens
  misc_feature: GZ8MTXP01BMH8K.13.33.C11.1.454.CMB.2.raw
  modified_base (210)..(210): a, c, t, g, unknown or other
  modified_base (353)..(353): a, c, t, g, unknown or other
  modified_base (468)..(468): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggccaggagtggtgaagccttcggagaccctgtccctntagttgtaatgtgtctggtgctacctaagtagactacttatacgtgggctggactccggcacgcccccgagggaagggctggagtggagttggggatagtctacttagtaggtggaagtaacgaactacaactccgtacctanaagacgtcgagtcagtcaaatactcgtagactacggtacaaggaacgtaacttacctcccgtaagtaaaggttgacgtttacgtgtacgacccgttcaccgaagaccgaacggtntcgttactatttaggtgtacgacgaagaaccggtataaaagtagttgggttaacgagggtagttaacgtacgttacggtggggaccgaacgggtacccttagggttccacccggttcctccgtaacgacggtaccccttacccgaaccgaaccgggtccccg

SEQ ID NO: 397825 - DNA, 682 bp, Homo sapiens
  misc_feature: GZ8MTXP01AZY2T.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcagtgaaggtctcctgacaagacctcgtaggactaccaccgtcaccgacgaccatatatacgtgggtgcgacgcggccccgtaggacgaggtccttggaggtggagtagggacatatcgacgtccctgtacgaggtggtccgacctaaacgtaaagtttcgacctaaaacgtaacgtaacgtttacgaaagggtacgacggggtaccaacgtacgtacgaacccgaacgggaacctaaccgtaccaactaccaaaccgacacgtaccctaacgtagtacggtaacgtaggaacgggggaactacccgtaaagactacgtacgaccgtaacgtaccgggttacctttaagttagttacgtagaaactaaagttaaagtaaacgttacgaaacgtaaacgttagttcgttacgtttaagagttaaggtacggggtacgggaaccgtaacgggttaactaacgg

SEQ ID NO: 397826 - DNA, 604 bp, Homo sapiens
  misc_feature: GZ8MTXP01EWBT4.13.33.C11.1.454.CMB.2.raw
  modified_base (221)..(221): a, c, t, g, unknown or other
  modified_base (276)..(276): a, c, t, g, unknown or other
  modified_base (351)..(351): a, c, t, g, unknown or other
  modified_base (362)..(362): a, c, t, g, unknown or other
  modified_base (429)..(429): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtggggcctnagtgaaggtctcctgacaagacctcgtggactaccaccgtcaccgacgaccatanatacgtgggtgcgacgacggcccctggacgaaggccttggagtggagtgggacatatcacgcctgtcagtggtcnccaataagttnacaaacagtaacttcgaggacgaggtacacatcgaccacggacacgtccatacaacacacgacctanatacggaactggaacggggaacgtaccgtaaagacgttacgacgaaccgtaacgtaccggttaccgtttaattagttcggtaacgaataaagttaaaggtaattacggaacctaaagttgttgttacgttttaagagttaaggtgggtacggggaaccgtaaggggttctaacgg

SEQ ID NO: 397827 - DNA, 694 bp, Homo sapiens
  misc_feature: GZ8MTXP01B99OO.13.33.C11.1.454.CMB.2.raw
  modified_base (221)..(221): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagcgtggtgcagtcgtggggctggaggtgaagagccgtgggcctnagtgaaggtctcctgcaagcctgtggataccaccgtcaccgacgaccatatatacgtgggtgcgacgacggcccctaggacaaggtccgttaggaggtaggaggtaggactatactcgaccgtcccgttgtcgtaggtcggtcccgacctaacgttaagttcgacctaaacgtaacgtaaccgtttacggaacgggtacggtacgggtacccaacgtacgtacccggaacccgtacggaaccctaccgtacctaacctaccaaaccgaccgacgtaccctaacgaacgtacggtaacgagggaacggggtacgtaaccgtaaagtacgtacggtaacgacccgtaaccggtaccggtttacgttttaattagttacgtagtaaactaaagttaaagtacgttacgaaaccgtaagttagttcgttcgtttaagtacgttaaggtgggtacgggaaccgtaacggaacgtaacg

SEQ ID NO: 397828 - DNA, 641 bp, Homo sapiens
  misc_feature: GZ8MTXP01BOTR3.13.33.C11.1.454.CMB.2.raw
  modified_base (481)..(481): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagagccgtgggcctgagtgaaggtctcctgacaagacctcgtggactaccaccgtcaccgacgaccatatatacgtgggtcgcgacgacggcccctaggaaccgaacgggtccttaggaggtggagtagggacatactcgacgtcccgtgtcgagtcggtccgacctaacgtaaagtttcgaccaaacgtacgttaacgtttcgaacggaacgtacgggtaccaacgagtaccgaccgaacggaccacgtacaataccaaacacacgaccctaanagtacgaataggagggtacaccgtaaagctacgacgacgacgtacggttacgttattagtgtgaactaaagttaaagtaagttacgaacgtaaacgttagttcgttacgtttaagtagttaaggtcggggtacggggttaaccgaagggttaacgtaacg

SEQ ID NO: 397829 - DNA, 780 bp, Homo sapiens
  misc_feature: GZ8MTXP01CPZ83.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagagccgtgggcctgagtgaagtctcctgacaagctcgtggataccaccgtcaccgacgaccatatatacgtgggtcgacgacgacggccccgtaggaaccgaaacggtcctaggaggtaggagtacggggacattacgtcgacgtccccgttaggtaccgaggttcgggtaccgacccgtaaacgtaaaggttttcgaacctaaaccgaaacgttaaccgtttacgaaacgggaaacgtaacggggtaccaaccgagtaccgaacccgaccggaaccgaaccgtaccaactaccaaacgaaccgacgtacccttaacgaacgttaacgggaaacgttacgggaacggggtaacgtaaccgttaaaacgtacgttaccgtacggaaacccggtaccgtaaacccgggtttaacccgttttaagtttaacgtttaggttaacggtaaccttaaaacgttaaaaggttaaacgtttaacggaaaccgtaaaaccggttagttcggtttaccgttttaaggaacgtttaaggttacggggttaccgggggaaaccggtaacggggttaacccgttaacgg

SEQ ID NO: 397830 - DNA, 610 bp, Homo sapiens
  misc_feature: GZ8MTXP01C3DWW.13.33.C11.1.454.CMB.2.raw
  modified_base (353)..(353): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccgttcggacgaccctgtccctcagttgtaatgtgtctggtgctccctaagtgactacttactacgtgggctggactccggcacggacccccgagggaacgggcgtggaggtggagttggggatatctcttagtagtgggagtacgaactacaatccgtcctnagacgtcgagtcatcaatatccgtaagactaggtaccacggaacgtacttctaccctagaaacggtgtacgttcgtagtacgaccgttcgctagacgtacggcttgttactttagttacgttgtcgacgagtaccggataaaatgttaggttacgagggttgtaaccgtacgttacggtcgggaccgaacgggtacccttcgggttccacccgtcgtccctcgtccgccttacccctaaccgaaccgggtaaccccg

SEQ ID NO: 397831 - DNA, 592 bp, Homo sapiens
  misc_feature: GZ8MTXP01CSLBX.13.33.C11.1.454.CMB.2.raw
  modified_base (166)..(166): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggancccactcccaggtgcagctggtgcagtctggggctgaggtgaagagccgtggggcctcagtgaaggtctccgtgcaagacctctggatacaccgtcaccgacgaccatatatactgggtgcgacacggccccctaggacaacggcctttgagtggatgggacatatcacgtccctgtcccagtggtgaccaacgtaaaagtttgcaacagtaactttcgaggacgagggtcaccgatacgaccgacgacacgtcactacaacacacgacctacagtaggggaacctagggagacgacctaaaggactcgtacggaaccgtaacgtaaccgggttaccgttttaacttaagttagttagtaacaaagttaaaggtattacggacttaaacggtaatacgttctttagtattagtgttcggggaaccg

SEQ ID NO: 397832 - DNA, 717 bp, Homo sapiens
  misc_feature: GZ8MTXP01EURSG.13.33.C11.1.454.CMB.2.raw
  modified_base (199)..(199): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcggccccggganagaccgccacaattcctgtagaaggaaacacttagatcagatgtcactgacagcagatcaggccaggccctgtggtcgtcagtctagtagggataacgtacccggccctgtcgggactccccgtagtacccgtatttcctcgtacggcctacccccgaaccggtcgggggaaaccaccggcccaaacccgtgaaccctataccaaacgagaccgacccgaaagggtaccggggataggacggtactacggtaacgtttaatttaagttggttacgtaggggttggtacggggaaacctagggacccgtaaaccccggggtaacggggtttaggaacgtttaacggttccggggacccggggtacccggggaaccgaacggtcgttaccggacccgttaccggtaggtaacccgaccggacccgaacggggttccccgtcccggtcccccgttcggttcccttacccgttcccgtcccgtttccccgtacccttccgttaccgttaacgttccggtaag

SEQ ID NO: 397833 - DNA, 814 bp, Homo sapiens
  misc_feature: GZ8MTXP01B83X3.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtgggctggaggtgaagaagccgtggggcctgagtgaaggtctcctgcaagacctctggatacaccgtcacccgacgaccatatatacgtgggtgccgacgacggccccctggaccaaggccttgacggtggagtgggacatatcgacgtccctgtccgaggtggtcgaccctaacgtaaaaacgtttcgcgaaacgtaacggttaaaccttttcgaacgggtaccgtaagggggttacccaacccgtaagttaccggaaaccccgaaccggggtaaccctaacccgggttaccccaaacgttaacccgaaaacccaaccgaacggtaccccttaaacgaacggttaacgggggtaaaccgttacgggtaaacggggaaccgttaaccccggtaaaagtaccgttaaccgttaaccgggaaacccgtaaacccgggtaacccgggtttaaccccggttttttaaacgtttaaacggttttacggttaagggttaaaccgaaaacgttttaaaacggtaagtttaaccgggttaaccttaaaaccgggttaagttacggtttaaccgttttaacggtagtttaacgggttaacgggggttaaccgggggttaaaccccggg

SEQ ID NO: 397834 - DNA, 737 bp, Homo sapiens
  misc_feature: GZ8MTXP01C7L80.13.33.C11.1.454.CMB.2.raw
  modified_base (277)..(277): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccacctcccaggtgcagctggtgcagtcgtggggctggaggtagaagacgccgtgggcctcagtgaagtctcctgacaacgacctcgtgactaccaccgtacaccgacacatanatacgtggtcgcgacgcggccccgtaggacacggcttaggagtggagtggacatatcgacgtccgtgtcgaggtcggtccacctaaacgttaaggtttacgacctaaaccgtaagttaaccgtttacgaacgggtaacccggtaacgggtacccaaccgtagtaccggaaccccgaacggtaaccctaaccgtaacccaacttaacccgaaactaccaaccgtacctaacgtacggtaacggtaaacgtacgggaaacggggtaaccgaaaccgttaaagtacgtaccgtaacggtacccggtaaccggttaaccggtttaccgttttaagtttaacgtaggttacgaaaacgtaaagttaaacgttaaacgttcgtaaaacgtaacgttaagtttctttaagtttaagtaagttcgggtaagggtaccggggttaaccggaacgggttaacctaaccgg

SEQ ID NO: 397835 - DNA, 698 bp, Homo sapiens
  misc_feature: GZ8MTXP01DR2CO.13.33.C11.1.454.CMB.2.raw
  modified_base (200)..(200): a, c, t, g, unknown or other
  modified_base (239)..(239): a, c, t, g, unknown or other
  modified_base (377)..(377): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcacttttacagcttctgtggcctcctatgagttgactcagccactctcagtgtcaggtcggccccggganagacgccacaattccctgtgaggaaacaacttagaagtnagaatgtccactgaccagcagaagtcaggcacggcccctgtggtggtcatctaagtaggggaataagtaaccccggcctcgtcggggactcccgtagaccgtattcctcgtggccctacccgaaccgtcggggaaccnccggcccaacccctagaaccataccaaacgacacgacccgaaagggaccggggatacgaggtctaggtacttattaagttgtacgagggttgagggacacgccgaacgggtacggtagaacgtttacgggtcgggccgggaccggggtaaccaaacgggtcccttacgggaaccccggtttcccggtaacggggttaaccgaaccggttaccccgaaacgggttcccgtcccggtccccccgttccgggttccttaaccccgttcccgttacccgttccccctaccccttccgttaccgttaacgttaaccgggtaaccgg

SEQ ID NO: 397836 - DNA, 561 bp, Homo sapiens
  misc_feature: GZ8MTXP01CB4GZ.13.33.C11.1.454.CMB.2.raw
  modified_base (282)..(282): a, c, t, g, unknown or other
  modified_base (441)..(441): a, c, t, g, unknown or other
  modified_base (530)..(530): a, c, t, g, unknown or other
tcagtcacgtactacacgaccggtgctcgatttagagtgagctcgttgggtttggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagaagctggggcctcagtgaaggtctctgcaagacctctggatacaccgtcaccgacgaccatatatacgtgggtncgactaggcccctggacaaggccttgagtggatgggacagtatcgagccctgtcccgaggtggtcgccaacgtaaaaagtttcgcaacgtaagtaaactttcgaaggacgagggtacacatagaccaacgggacacgtaccatcaaacacagccctaanagtggggaactggagacgacctaagactctacgacgacacgggtaccttataacgttgttgtacaaagtaaagtaattcggcaaaggtntaggtcttttaggattagtggttgggaaccg

SEQ ID NO: 397837 - DNA, 633 bp, Homo sapiens
  misc_feature: GZ8MTXP01ESGGX.13.33.C11.1.454.CMB.2.raw
  modified_base (248)..(248): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtggggcctgagtgaaggtctctgcagacctntgatacaccgtcaccgacgaccatatatacgtgggtgcgacgacggcccctaggacaaggtccttaggacgtggagtgggacagtatcacgccctgtcccgaggtgtcgacctaactaaaagtttcgctaacgtaacggtaacctttacgaagggacgtacggggtaccaacccgtataccggaccgaacggacctacgtaccataccaacacacgtacctaacagtacggggaaacgttggaacggtacgaaccgttaaagacgttacgtacggaaccgtaaccgtaacggttccgtttaattaagttgttagaacttaaagtaaagtaagttaggaaccttaaagtgttattcgtttatagttagttggggttaacgggaacg

SEQ ID NO: 397838 - DNA, 629 bp, Homo sapiens
  misc_feature: GZ8MTXP01B54WK.13.33.C11.1.454.CMB.2.raw
  modified_base (221)..(221): a, c, t, g, unknown or other
  modified_base (282)..(282): a, c, t, g, unknown or other
tcagtcacgtactacacgaccggtgctcgatttagagtgagctcgttgggtttgggacccagcacccacatctgtcctctagagaatcccctgagagctccgttcctcaccatggactggacctggaggatcctcttcttggtggcaacagccacgaggacgcccactcccaggtgcagctggtgcagtcgtggggctggaggtgaagagccgtgggcctnagtgaggtctctgcagcctcgtggataccaccgccaccgacgacatatactacgtgggtcncgacgacggcccctggaacaggccttaggagtggacgtgggacatactcgacgtccctgtcaggtggtcgaccaagtaagttcgaccaacgtaacgttaaccgtttcgaaagggtaccgtacgggtaccaaccgtagtaccgacccgacggacctaccgtcaactaccaaacacgaacgtaccctaacagttaaccgaacgtaggaacggggacgtaaccgttaacgacttacgacgaacgaccggtacgttaccgtttaatacgttgtcgaataagttaacgtaattcgaacgtaaagttgttccggttatttgagttggtaggtcgggaccgtaagggaactccg

SEQ ID NO: 397839 - DNA, 766 bp, Homo sapiens
  misc_feature: GZ8MTXP01ATNK6.13.33.C11.1.454.CMB.2.raw
  modified_base (714)..(714): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcaggttggtgcagtcgtggggctggaggtagaagaagccgtggggcctcgagtgaaggtctcctgacaagcctcgtggactaccaccgtaccaccgacgacctatatagtacgtgggtcgcgacgaccggccccgtaggaacgaacggtccgttggaggtgggagtaggggaactagtacgtcgacgtccccgttggtaccgtaggttcggtaccgaacccccgtaaacggttaaacggttttcgaaccgtaacgtaaaacggttaaacctttaacggaaacgggtaaccggtaacggggtaccccaaccgtaacgtaccggaaaccccgtaaccggtaccgaacccggttaccaacctaaccaaaccgaaccgaaccgtacccgtaaacgtaaggtaacggtaaaccgtagggaaccggtaaccggtaaacgtaaaggtacgtaccgtaaggaacccgtaacgttaccggtttacgtttattacgttagtacgtaactaaagtaaacgttagttacgaaccgtaaagtgttacgttntttaggaagttagggttaacggcggggaacttaacgggtcttaacggtaacg

SEQ ID NO: 397840 - DNA, 632 bp, Homo sapiens
  misc_feature: GZ8MTXP01EAS53.13.33.C11.1.454.CMB.2.raw
  modified_base (590)..(590): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccaaaaggacgcccactcccaggtgcagctggtgcagtcgtggggctggaggtgaagagccgtggggcctcgagtgaacggtctcctgacaagacctcgtaggataccaccgtacaccgacgaccatatatacgtgggtgcgacgacggcccctggacaaggtcctggagtggatgggaactagtatccgacgccctgtcgaggtggtcacccccaataaagttcgactaacgtaaacgtaacgtttcggaaggaaccgtacgggttaccaacgtatcgaacccgacggaacaccggtacaactaccaaacgacacgtaccctaagagtacggaagtagaggaacgacctaagacttcgagaacgaccgtacgttacgtttattacgtgtgaactaaataagttaagttcgaacgtaaacgtattggttcttttaggntttaacgtgggttacggggacccgaagggtcccttaaggtcg

SEQ ID NO: 397841 - DNA, 574 bp, Homo sapiens
  misc_feature: GZ8MTXP01CBIMO.13.33.C11.1.454.CMB.2.raw
  modified_base (480)..(480): a, c, t, g, unknown or other
  modified_base (494)..(494): a, c, t, g, unknown or other
  modified_base (500)..(500): a, c, t, g, unknown or other
  modified_base (550)..(550): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctccagatggggcctgtcccagctgcagctgcaggagtcgggccaggagtggtgaagtccttcggagaccctgtccctcagtttgtaatgtgtctggtgctcctaagtaggactacttactacgtgggctggatccggcacggcccccgagggaagggcgtggagtggagttggggatatcgtcttatagtgggagtaacgaactacaactccgtcctacaagacgtcgagtcatcaagtatccgtagaacagggtccaaggaacgtaattctaccctagaaagtgaagttctagtagaccgtcgccagaacacggcttagtacttaattaagttgtgacgagacgganaaaatgtagggtanaggggngttaacgacttaacgtggggaccgtaagggaacccttgggcaccgtctcncacgccttaccaaccgaacggccc

SEQ ID NO: 397842 - DNA, 737 bp, Homo sapiens
  misc_feature: GZ8MTXP01CB6LX.13.33.C11.1.454.CMB.2.raw
  modified_base (253)..(253): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagaagccgtgggcctcgagtgaaggtctctgacaagacctgnggactaccaccgtcaccgacgacatatagtacgtgggtcgccgacgacggccccgtaggaaccgaaggtcctaggaggtgggagtagggaactattacgtccgacgtccccgtggtacccgtagggttcggtcgaccctaaacgttaaaaacggtttcgaacgtaaacgtaaacgttaaacctttacggaacgggtaaccggagggttacccaaccgtaagtaccggaacccgtaacgggaacctaaccggtacccaactaaccaaacaccgtaaccgtacctaacgtagtaacggggtaaacgtagggaacggtaacgaaccgtaaagtacgtacgtacgaaccggtaaaccgtaccgggtttaaccgttttaagttaagttggttactaaacgttaaaacgttaaagtaacgttacgacgttaaaacgttgttacgtttaagtttaggtagttacgggttcgggttaacggggtaaaccggg

SEQ ID NO: 397843 - DNA, 705 bp, Homo sapiens
  misc_feature: GZ8MTXP01B6O6Q.13.33.C11.1.454.CMB.2.raw
  modified_base (270)..(270): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatanatacgtgggtgcgacgacggcccctggacaaggccttgagtggatgggactatatcacgccctgtcaggtcggtcgcctaacgtaaagtttcgacctaaacaacgtaacgtttcgaaagggtacgtacggggtaccaaccgagttaccgaacccgaaccggaaccaaccggtacccaactacaaaaccctaccgaacggtaccctaaccgaagtacgggaaaccttagggaacggggaacgtacccggttaaaagacgttaccgtacggtaaccgaaccgtaaccggggttacccgttttaaagtttacgttaggtaggtaacctaaaagttaaagggtaaactttaggaaacctaaaacggttagtttcgttacgtttttaaggaattaacggttagggtacggggttaacccgtaaaggggttaacctaacgg

SEQ ID NO: 397844 - DNA, 659 bp, Homo sapiens
  misc_feature: GZ8MTXP01DERPZ.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtgggcctcgagtgaaggtctccgtgacaagaccgtcgtggaactacgaccgtcaccgacgaccatatatacgtgggtcgcgacgacggcccctaggaaccaaggccttagaggtggagtgggacatagtcacgtcctgtcaggtcggtcgacctaagtaagtttgactaaacgagtaaccttcgaagggacgacgggtacaaccgatacgaccacgacaccgtaccaactacaaacacacgacctacagtaggaactggaacggggacgtaaccgtaaaggtactaccgtacggaaccgtacggtaaccgggttccgttttaagttacgttacgggtaagtaaacgtaaaagttaaagtaaacgttacgaaacgtaaagttagttcgtttacgtttaagtaagttaacggtcgggtacggggttaaccgtaacggttaacgtaacg

SEQ ID NO: 397845 - DNA, 684 bp, Homo sapiens
  misc_feature: GZ8MTXP01CXEBX.13.33.C11.1.454.CMB.2.raw
  modified_base (282)..(282): a, c, t, g, unknown or other
  modified_base (433)..(433): a, c, t, g, unknown or other
  modified_base (473)..(473): a, c, t, g, unknown or other
tcagtcacgtactacacgaccggtgctcgatttagagtgagctcgttgggtttggggacccagcacccacatatgtcctctagagaatcccctgagagctccgttcctcaccatggactggacctggaggatcctcttcttggtggcaacagccacaggacgcccactcccaggtgcagctggtgcagtcgtgggctggaggtagaagagccgtgggcctcgagtgaaggtctcctgacaacgtacctcgtggaactaccaccgtccaccgacgaaccatanactacgtggtgcgacgcggcccctggacgaacggtccttggaggtggagtaggactatactcgacgccctgtacgaggtcggtccgacctaagtaaacgtttcgacaaactaacgtaactttcgaaacgggaacgtacgggtaccaccganaccgaccacgaccacgtccaactacaaacacacgacctanagtacggaacgtggaacggggtacaccgtaaagaccgtacgtaaccgacgtaccgtaaccggttacgttttaaacgttagtacggttagaaactaaaagttaaagttaaacgttacgaaaccgtaaaggttactttccggtttaacgtttttaaggaaagtttcgggtacggggttacgggggaaaccgtaaaggggttaaccttaacggg

SEQ ID NO: 397846 - DNA, 782 bp, Homo sapiens
  misc_feature: GZ8MTXP01DMIQE.13.33.C11.1.454.CMB.2.raw
  modified_base (712)..(712): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagcgtggtgcagtcgtggggctggaggtagaagagccgtggggcctcgagtgaaggtctcctgacaacgacctcgtaggactaccaccgtcaccgacgaccatatagtacgtgggtgccgacgacgccccgtggaacgaacggtccttaggaggtaggagtgggaactagtatccgacgtcccgtggtaccctaggtcggtacgaccctaaacgttaaaacgtttcgaaccaacgtaaacgtaaaccgtttcgaacggggtaacgtacgggggtacccaaccgtagtaccggaaccgaaccgggaaccaccgtaacctactaaccaaaccacccgaacgtaaccctaaacgtacgtacggggggtaaacctaggggaaacggtaccgtaacccgtaaagtaccgttacgtaaccggaacgtaacccggttaccgggtttaacccgttttaaagtttaacgttggttaaccggtaaaacttaaaagttaaaaccggttaagttaacgggttaaacccttaaaacggggttntttaaccggttttaacgttttaaacggtacgttagggttaacgggggttaacccgggggtaaaacccggg

SEQ ID NO: 397847 - DNA, 811 bp, Homo sapiens
  misc_feature: GZ8MTXP01D05WA.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagacgccgtgggcctcgagtgaaggtctcctgcaagacctcgtggactaccaccgtcaccgacgaccatatatacgtgggtgaccgacgacggcccccgtaggaaccgaacggtccgttaggaggtggagttaggggactagttactcgaccgtcccttagtaccgaggttacggtacccgaacccgtaaagttaaacggtttcgaccctaaaacgtaacgtttaaccgtttacgaaacgggtaacgtacggggtaccaaccgtacgtacgaaccccgaacggaacctacccgtacctaactaacccaaaccgaccgaacgtaccctaacgaacgtaacgggtaaaccgtaggggaaacggggtaaccgtaaacccggttaaagtaccgtttacggaacccggtaaccggtaacccggttaaacccggggttttaccctttttaaagtttaacgtttacgggtaaataaacgttaaaacgttaaaggtaaacgttttaacggaaacccgtaaaacggttacgtttagtttaccgttttaagggtaagtttaaccgggttacgggggtaccggggttaaaccgaaacggggttaaccttaaccggg

SEQ ID NO: 397848 - DNA, 727 bp, Homo sapiens
  misc_feature: GZ8MTXP01AC41R.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagagccgtgggcctcagtgaaggtctcctgacaagacctctaggactaccaccgtcacccgacgaccatatactacgtgggtcgcgtacgacggccccgtaggaccaagggtccttggacggtggagtacggggacagttaacttccgaacggtcccccgttaggtaccgtagggttacggggttaccccgacccgtaaacgttaaaacgggttttccgaacccgtaaaacgttaaacggttaacccgttttcggaaacgggtacgtacggggttaccaacgtacgtacgaacccgacggtaacctaccgtaccaactaccaaaccgacgacgtacccaagacgtacggaaacgtcggaacgggggtacgtaccggtaaagacgttacgacgacgtaaccggtaacggttccgtttaagttaccgttgtacgtaacgtaagttaaagtaacttcgaaacgtaacgttgttacgttacgtttaagagttaacgtgggttacgggacgtaaacgggaactaacgg

SEQ ID NO: 397849 - DNA, 722 bp, Homo sapiens
  misc_feature: GZ8MTXP01BGMLQ.13.33.C11.1.454.CMB.2.raw
  modified_base (671)..(671): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcaggtcgtggggctggaggtgaagagccgtggggcctgagtgaaggtctcgtgcaacgcctcgtaggactaccaccgtcacccgacgaccatatatacgtgggtgcgacgacggcccccgtagggaaccaaggccgttaggaggtgggagtacggggaactagttacgtcgaccgtccgtcgtccgaggttcgggtacaccctaaacgtaaaagtttcgaacgtaaactaaacgttaaaccgtttcggaacgggtaccgtaggggtacccaaccgagtaccgaacccggacggaaccaccgtaccaacgtaccaaccacaacgtacctaagtaacggtacggggaacgtacgggaaccggagtaacccgtaagaccgtacgtaacggaccgtaaccggttaccgggttaccttttaattaaggtttaacgttacggtaaacttaaaggttaaacgtaagtttacgaaacgttaaacggttnttaggttaacgtttaggaagttacggttaacggggttaacgggtaaaccgg

SEQ ID NO: 397850 - DNA, 786 bp, Homo sapiens
  misc_feature: GZ8MTXP01D6AGY.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagcgtggtgcagtcgtggggctggaggtagaagacgccgtgggcctgagtagaaggtctcgtgacaacgacctcgtaggactaccgaccgtcaaccgacgacatatatacgtggtcgacgacgaccggccccgtaggaaccacgggtcctttaggaggtgggtagtacggggaactaagttacgtaccgaacggtccccgtaggtaccgaggttcggtacgaccctaaacgttaaaaaggtttccgaactaacgaaacggttaaacctttacgaacgggtaacgtacgggtacccaccgtaacgtacggaacccgaacggaccctaccgtaaccaactaaccaaacacaaccgtaccctaaagtacgtacggggtaaacgtcgggaaacggtaccgtaaaccgtaagtacgttaccgtaaacggtacccggtaaacccggttaccggtttaccgtttttaagttaacgtttaggttaaggtaaaacccttaaaagttaaacgggttaaattaacgggttaaacccttaaaaacggttgtttacggtttaacgttttaaggtaacgttacgggtttaacgggggttaaccggggtaaaacccggg

SEQ ID NO: 397851 - DNA, 696 bp, Homo sapiens
  misc_feature: GZ8MTXP01EHYE4.13.33.C11.1.454.CMB.2.raw
  modified_base (246)..(246): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtagaagagccgtggggcctcgagtgagtctctgacaagacctntggactaccaccgtcaccgacgaccatatatacgtgggtcgacgaccgacgggtcccctaggaaccgaacggtcccttaggacggttgggagtacggggactaattacgtcgacggtccccttggtaccgagggttcgggttacccgacccgtaaacgttaaaaggtttcgacctaaaacgtaacgttaaccgtttacgaaacgggtaaccgtacggggtaccaaccgagtacccgacccgaacggacctaccgtaccactacaaaccacacgaccctaacacgtacggaacgtggaacggggaacgtaccgtaagtactccgtagaccgtacgtaccggttacgtttaattagttcggagaactaaagttaagtaattacgaaacgtaaacgttgttcgttagtttaagagttaacggtgggtacggggaaccgtaacgggttctaacg

SEQ ID NO: 397852 - DNA, 606 bp, Homo sapiens
  misc_feature: GZ8MTXP01BEA0J.13.33.C11.1.454.CMB.2.raw
  modified_base (219)..(219): a, c, t, g, unknown or other
  modified_base (287)..(287): a, c, t, g, unknown or other
  modified_base (337)..(337): a, c, t, g, unknown or other
tcagtcacgtactacacgaccggtgctcgatttagagtgagctcgttgggtttgggacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagccgtgggcctnagtgaaggtctcctgcaagacctctaggactaccgaccgtcaccgacgaccatatagtacgtgggtcncgacacggcccccgtaggaccaaggccttagacgtggatgggaccatacncacgccctgtcagtcggtccgaccactaaagttcgacaacgagtaacttcgaagggtacgagggtccaacacgtacgaccgacggacacgtaccaactaccaacgacacgccctaagagtacggaactggacggggactaccgaagactacgtacggaccgacgtaccgggtcctttaagtcgtgtagaactaaattaaaggtacttcgaacgtaaacgttgttcgttacgttaagagttaaggtacgggtacggaccgtaaggctaag

SEQ ID NO: 397853 - DNA, 642 bp, Homo sapiens
  misc_feature: GZ8MTXP01CRF78.13.33.C11.1.454.CMB.2.raw
  modified_base (281)..(281): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaacgccgtggggcctcgagtgaaggtctcctgacaagacctcgtaggactaccaccgtacaccgacgaccatanatacgtggtgcgacgacggccccgtggacacggtccttagagtaggagtggacatatcacgtccgtgtcgagtggtaccgaccaacgtaagtttcgactaaactaagtaacttacgaacgggacgacgggtaccaacgagtacgaccgaacggaacaccgtacaacaccaaacacgaacgtaccctaacgacgtaggaaacgtaggagggacgaacgttaagacttcgacgaaccgtacgtaccggttacgtttaatacgttgtagtaacaaagttaaacgtaagttagtaaaccgtaagttacgttcgttacgtttaagaagttaagttcggggacggttacccggtaaggttctaaccg

SEQ ID NO: 397854 - DNA, 705 bp, Homo sapiens
  misc_feature: GZ8MTXP01B98QP.13.33.C11.1.454.CMB.2.raw
  modified_base (247)..(247): a, c, t, g, unknown or other
  modified_base (535)..(535): a, c, t, g, unknown or other
  modified_base (665)..(665): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttctggtggcaacagccacaggacgcccactcccaggtgcagctggtgcagtcgtggggctggaggtgaagagcctggggcctcgagtgagtctctgacaagcctnggatacgccgtcaccgacgaccatatatacgtgggcgcgacacggcccctagggacaggccttaggaggtaggacgtagggaactagtactcgacgtccctgtacccgtaggttggtcgaccccgtaaacgtaaaaaacggttttcgaaccgtaaaccgtaaacggttaaaccgttttaccggaacggggtaaccgtacgggggtacccaacccgtagtaaccggaacccgaaaccgggtaccaaccggttaccccaactaacccaaacccacaaccgtaaccccaanaacggttaaccggggaaacgtagggaacggacgtaacccgtaagtactcgtacgaccgtaacgtaccggttaccgtttagttaagtagttaggaacttaaagtaaacgtagttacggaacttaaacggtnttggttaactttagagttagtcgggttaacgggtaaccgg

SEQ ID NO: 397855 - DNA, 733 bp, Homo sapiens
  misc_feature: GZ8MTXP01BGTD8.13.33.C11.1.454.CMB.2.raw
  modified_base (226)..(226): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagcgtggtgcagtcgtgggctgaggtagaagagccgtgggcctnagtgagtctctgacagcctgtaggataccgaccgtcaacccgacgacctatatactacgtgggtacgacgacgacggccccgtaggaacgtacggtccttaggagtcggagtagggactagtactcgacgtcccgtgtccccgtaggtcggtacgtacccgtaaacgttaaaacgtttcgaacctaacgtaaacggttaaacctttccgggaacggtacggtaacgggtaccctaaccgtaagtaccggaacccgaccggaaccgaccgtacctaactaccaaaccgacaaccgacctaacgtacgtacggggtaacgtacggtaacggtacgtaaccgtaacgtaccgtacgtaaccggtaaccgtaaccggttaccggtttaaccgtttaacgtttaagtttcggttaagtaaaccttaaaggttaaagtaacgttaacgttaacgttaacgtgtttaacgttcgttttaaggacgttaggttcggggttaacgggtaaaccggg

SEQ ID NO: 397856 - DNA, 568 bp, Homo sapiens
  misc_feature: GZ8MTXP01BLU6A.13.33.C11.1.454.CMB.2.raw
  modified_base (350)..(350): a, c, t, g, unknown or other
  modified_base (503)..(503): a, c, t, g, unknown or other
  modified_base (528)..(528): a, c, t, g, unknown or other
  modified_base (538)..(538): a, c, t, g, unknown or other
  modified_base (548)..(548): a, c, t, g, unknown or other
  modified_base (550)..(550): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctcccgtaagtaggactacttactacgtggggctggatccggcacgcccccgagggaagggcgtggagtggagttgggatatctcttatagtgggagtacgaactacaatccgtacctanaagtacgtcgagtcatacaatagtccgtaagactacggtaccaaggaacgtaattacctaccctagaaagttcggtaagtttccgtggtacggaaccggttcgacgtaagaccgacggtctagtccttaattagttcgtgaccgagaccgtanaaatgtgtcagggtatcgattacgnggcaggaccnggcacgctcncncgtccacaacgcggtccc

SEQ ID NO: 397857 - DNA, 700 bp, Homo sapiens
  misc_feature: GZ8MTXP01E0HLJ.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactgggcctggaggatcctcttcttggtggcaacagccacaggacgcccactcccaggtgcagctggtgcagtcgtggggctgaggtgaagagcctggggcctcagtgaggtctctgcagctctgatacaccgtcaccgacgaccatatatacgtgggtcgcgacgacggcccccgtagggaacctaaacgggtcccgtttaggagggttagggaacgttagggggaaacctagttaactccgaacggtcccccgttgttaccgagggttcggtaccgaccctaagtaaaacgtttcgaccctaaaacgtaacgggttaactttaccggaaagggtaccggtacggggtaccacctagtaccgaacccgacggactaccgtaccaactacaaaccactacgaccgtaacagtacggaaacgtggaacggggtacgtaacgtaacgtactccgtacgaacccggtacgtaccgggttactttattacgttgtagaactaaagttaaagtaagttacaaacgtaaacgttagttgttacgttttaagacttaaggtcgggtacgggaccgtaaaggggccctaagg

SEQ ID NO: 397858 - DNA, 673 bp, Homo sapiens
  misc_feature: GZ8MTXP01EDKA7.13.33.C11.1.454.CMB.2.raw
  modified_base (288)..(288): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctgggtgcagtcgtggggctgaggtgaaggagccgtgggcctgagtgagtctctgacaagacctgtgatacaccgtcaccgacgacaatatagtacgtgggtcncgacgacggccccgtggacgaaggtcctaggagtggagtgggacagtagtccacgtcccgtgtacccgaggtcggtcgacccaacgtaaaagttcgaacaacgtaacgttaaaccgtttacgaacgggacgtacggggtaccaccgtacgtacggaacccgacgggtaaccaccgtaccaactaccaaacacgacgaccgtaacagtacggggaactagggaacggtacgtaccgtaaagacgtacgtaacgaccgtaaccgtaccgggttaccgttttaagttaagttcggttaataacgttaaaagttaaacgaagtttaacgaacttaacgtaacgttagttaacgtttagtaacgttagttcgggttaacgggtaaaccgg

SEQ ID NO: 397859 - DNA, 726 bp, Homo sapiens
  misc_feature: GZ8MTXP01BD2P0.13.33.C11.1.454.CMB.2.raw
  modified_base (532)..(532): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtagaagacgccgtggggcctcgagtagaacggtctccgtgacaaacgtacctgtaggaactaccgacccgtacgaacccgaccgaccataatagtacgtgggtacgtacgacgaccggccccgtaggaaccgaacgggtccttaggacggtagggtagtacgggggtaacaagttacgtaccgaccggtccgttcggtacgtaggttcggtaccgaccgtaaacgtaaacggtttcgacctaaaacgtaaacgttaacgtttacgaaacgggtacgtacggtaccgtaacacgtaccgaccgtacgacctaccgtacaactaacaaacncaacgcctaacgtacgtacgaacgtacggaacggggtaacgtaaccgtaaagtacttacgacggtaaccgtacgtaccgggttacctttaagttacttcggtaactaagtaaattaaggtaattacgtaaacgtaacgttagttcttagtttaagagttaacggtagggtacgggaccgtaaggggttctaacg

SEQ ID NO: 397860 - DNA, 746 bp, Homo sapiens
  misc_feature: GZ8MTXP01B45NV.13.33.C11.1.454.CMB.2.raw
  modified_base (252)..(252): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtagaagagccgtggggcctcgagtgaaggtctctgacaagcctntggataccaccgtcaccgacgacatatatacgtgggtgcgacgacggcccctggaaccaacggtccttaggacggtggagtgggtaaaccgtaacgttacgtaccgtaacggtacccgttacggtacccgtacgggttacgggtaccgtaccgtaaacgttaaaacggtttcgaaccgtaacgtaacggtaaccgtttacgaacggtaacgtacgggtaccaccgtagtaccggaccgtacggacctaccgtaccgtaacgtaccaaaccgtacgtacgtacccttaacgtacgtacgggggtaacgtacgggtaacggtacgtaaccgtaaacggtaccgttacgtaacggtaaccggtaaccgttaccgggtttaccgttttaagttaacggttacgttacgtaacgttaaagttaaacgtacgttacgacgttaaacggttgttacggttaacgtttaggacgttacggtccgggttaacgggtaacccgg

SEQ ID NO: 397861 - DNA, 757 bp, Homo sapiens
  misc_feature: GZ8MTXP01DPFP1.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagcctggggcctcagtgaaggtctcctgacaagacctctaggataccaccgtcaccgacgaccatatatacgtgggtgcgacacggccccgtaggacaaggccttagagtggagtgggacatatcgacgtcctgtccaggttggtcgaccctaacgtaaaaaacggttttgaaccgtaacgtaacgtaaaccgtttttcgaacggggtaaccgtaacgggggttacccaacccgtacgttacggaacccgaaccgggtaaccaaccggttacccaactaccaaaccgaccaacgaccctaacgaacgttacgggggaaaccttaggggaaacgggtaacggtaacccgttaaaacggacgttaccggtaacgggtaaaccggtaaccgtaaccggggttaccccgtttttaaagtttaacgtttaggttacgttaaaccgttaaagtttaaaacggtaagttttaacggaacccgttaaaacggttaagttacgtttaacgtttttagaacgtttaggttaacgggttaacgggggtaaaccccgg

SEQ ID NO: 397862 - DNA, 658 bp, Homo sapiens
  misc_feature: GZ8MTXP01BXO2H.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagagccgtgggcctgagtgaggtctctgcagcctgtggataccaccgtcaccgacgaccatatatacgtgggtcgcgacgacggcccccgtaggacgaacggtccttggaggtggagtagggactatacgtcacgtccctgtacgaggtcggtccaccgaactaaagtttcgacctaaaacgtacgttaaccgtttacgaacgggtaaccgtacggggtaccaaccgtagtaccgaacccgacggaccaccgtaccactaccaaacacacgtacctacgaagtacggaactgggaacggggacgtaccgtaaagacttcgacggaaccgtaccgtaccgggtttccgtttattagttgtagaactaaagttaaaggtattacgaaacgtaaagttgttcgttacgttttaagagttaaggttcggggacgggaccgaacggggttctaacgg

SEQ ID NO: 397863 - DNA, 648 bp, Homo sapiens
  misc_feature: GZ8MTXP01CF3OX.13.33.C11.1.454.CMB.2.raw
  modified_base (244)..(244): a, c, t, g, unknown or other
  modified_base (271)..(271): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagcctggggcctcagtgaaggtctcctgcaagacctnggataccaccgtcaccgacgaccatanatacgtggtgcgacgacggccccgtaggacaaggccttgagtggatgggacatatcacgccctgtcaggtggtaccgaccaaacgtaagtttcgacctaaaccgtaagtaaccgtttacgaacgggaaccgtacggggtaccaaccgaagtaccgaaccgacggaaccaccgtaccaataccgaaacacaacgcctaaacgacgtacggaaactaggaacggggtaacgtaccgtaaagactacgtacggaaccgtaacgtaacccgggttacttttaagttattagagtaactaaagttaaacggtaattacggaaactaacgttaagttgttacgtttaagaagttgtcgggtacgggacgtaaggaacgtaacg

SEQ ID NO: 397864 - DNA, 686 bp, Homo sapiens
  misc_feature: GZ8MTXP01BB0AG.13.33.C11.1.454.CMB.2.raw
  modified_base (250)..(250): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagagccgtggggcctgagtgaaggtctctgacaagcctntggataccaccgtcaccgacgaccatatatacgtgggtcgcgacgacggccccgtaggaacgaacggtcctggaggtggagtcgggaactagtactacgacgtcccgtggtccccgtaggtcgggtacgaccctaaacgtaaaaacggttttcgaaccgtaaacgtaacgttaaacgtttccgaacggggtaacgtacggggttaccaccgtagtacgaccgacggaccacgtacactaacaacacacgtacctacgacgtacgggaacgtaggacggtacgacgttaacgcttaccgacggaccgtacgttaaccgggttaccttttaagttaacgttacgttacggtaaacttaaagttaagtaaagttacgaacgttaaacgtgttacgttaagtttacggtagttacggtaacgggttaacggggtaaccgg

SEQ ID NO: 397865 - DNA, 652 bp, Homo sapiens
  misc_feature: GZ8MTXP01A1QWN.13.33.C11.1.454.CMB.2.raw
  modified_base (248)..(248): a, c, t, g, unknown or other
  modified_base (290)..(290): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtagaagaagccgtggggcctcgagtgaaggtctcctgacaagcctcgnggatacaccgtcaccgacgaccatatatacgtggtcgcgacncggcccctaggacaaggtccttagaggtgagtggacagtactcacgccctgtacgagtcggaccaccaagtaacgtttgaccaaactaagtaaccgtttacgagggtaccgacgggtaccacctagtaccgaccgaaccgggacaccgtacaactacaaaccacaccgtacctaaacacgtaacggaacgtacgaggggtacgacctaaaggactacgtacgaacgtacgtaccgggttcctttaagttcgttacgtaggaacttaaaaggttagtaaagttaccgaaacgtaaacggttacgttagttcgttttaagacgttaaggcggggttacgggaccggtaacgggaaccttaacgg

SEQ ID NO: 397866 - DNA, 676 bp, Homo sapiens
  misc_feature: GZ8MTXP01BHWMK.13.33.C11.1.454.CMB.2.raw
  modified_base (248)..(248): a, c, t, g, unknown or other
  modified_base (252)..(252): a, c, t, g, unknown or other
  modified_base (638)..(638): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggagatcctcttcttggtggcaacagccacaggacgcccactcccaggtgcagctggtgcgagtcgtgggctggaggtagaagacgcgtgggcctgagtgaaggtctcgtgcacgctntganaccacgtacacgacacatatatacgtgggtcaccgacgacggcccgtaggacaggtccttaggaggtggagtacgggaactagtagtccgtacgtcccgtaggtcccgtagggtcggtaccgaccgtaaacgttaaaacgtttcgaaccgtaaacgtaacgttaaacctttacggaacgggtaccgacgggttacccaacctacgtaccgaaccgacggaacctacgtaacccactaccaacactacgacctaacgacgttaaggggaacgtacggaacgtaccgtacgtaacgtacgttacgaacggtaaccggtaccgttaccggtttacgttttattaaggtgttactaagttaaagtaagttaacgttaggaaccttaagtnttacgttgtttagagttggtaacgggttcgggtaaccg

SEQ ID NO: 397867 - DNA, 586 bp, Homo sapiens
  misc_feature: GZ8MTXP01BD4WS.13.33.C11.1.454.CMB.2.raw
  modified_base (218)..(218): a, c, t, g, unknown or other
  modified_base (241)..(241): a, c, t, g, unknown or other
  modified_base (270)..(270): a, c, t, g, unknown or other
  modified_base (387)..(387): a, c, t, g, unknown or other
  modified_base (549)..(549): a, c, t, g, unknown or other
tcagtcacgtactacacgaccggtgctcgatttagagtgagctcgttgggtttggggacccagcacccacatctgtcctctagagaatcccctgagagctacgttcctcaccatggactggacctggaggatcctcttcttggtggcaacagccacaggagcccactcccaggtgcagctggtgcagtctggggctgaggtgaagagccgtgggcctnagtgaaggtctcctgcaagcctntggataccaccgtcacccgacgaccatanatacgtggtgcgacacggcccctggacaggccttgagtggatgggacagtatcgacgccctgtccagtggtcgaccacgtaagttgacaactagaactttcgaggtacagggtcacntacgaccacggacacgtacactacaaaccgacaacgccctaacgactacgggtaaactcggaaacgggggtacgtacccgtaaaggactcgtacggaaccgtacgtacggtaccgtttattagttacgtgaactaaagttacgtaattggaactaacgttangttacttgattggtggtacggggactaagggcctaag

SEQ ID NO: 397868 - DNA, 656 bp, Homo sapiens
  misc_feature: GZ8MTXP01BS1QB.13.33.C11.1.454.CMB.2.raw
  modified_base (218)..(218): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctnagtgaagtctcctgcaagacctctggactaccaccgtcaccgacgaccatatatacgtgggtgcgacacggcccctaggacaggctgagtggatgggactatatcacgtccctgtcaggtcggtccgacctaacgtaaaggtttgaccaaacgtacgttaactttcgaacgggtacgacggggtaccaccgatcgaacccgaacggacctacgtaccaataccaaacacaacgaccctaacgacgtacggaacctagggaacggggtaacgtaacccgtaaaggtacttaccgacggaaccgtaccgtaaccgggttccgttttaattacgttgggtacgaactaaaagttaaaggtaaacgtttgaactaaaacggatttcgttacttttaaggattaacggtacgggtacggggacctaacggggttaacctaagg

SEQ ID NO: 397869 - DNA, 526 bp, Homo sapiens
  misc_feature: GZ8MTXP01BYJGO.13.33.C11.1.454.CMB.2.raw
  modified_base (272)..(272): a, c, t, g, unknown or other
  modified_base (280)..(280): a, c, t, g, unknown or other
  modified_base (284)..(284): a, c, t, g, unknown or other
  modified_base (334)..(334): a, c, t, g, unknown or other
  modified_base (338)..(338): a, c, t, g, unknown or other
  modified_base (357)..(357): a, c, t, g, unknown or other
  modified_base (390)..(390): a, c, t, g, unknown or other
  modified_base (399)..(399): a, c, t, g, unknown or other
  modified_base (403)..(403): a, c, t, g, unknown or other
  modified_base (405)..(405): a, c, t, g, unknown or other
  modified_base (424)..(424): a, c, t, g, unknown or other
  modified_base (427)..(427): a, c, t, g, unknown or other
  modified_base (456)..(456): a, c, t, g, unknown or other
  modified_base (484)..(484): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctgggggcctcagtgaaggtctcctgcaagacctctggatacaccgtcaccgacgacatatanactgggtncganaggcccctggacaaggcctgagtgatggacatatcagcctgtcagtggcnccanaaagttgcaacagaacttnagacagggtcaccatcgacacggacacgccaanacaacacanacananagagagaggagactaaganacngacgacgacgtacgttattattagtgaanaaattaaataattagtaacgaacagttnttacttaatagtaagtggtacgggacgtaacggaacgtaacg

SEQ ID NO: 397870 - DNA, 612 bp, Homo sapiens
  misc_feature: GZ8MTXP01E1KXY.13.33.C11.1.454.CMB.2.raw
  modified_base (222)..(222): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggccctnagtgaaggtctcctgacaagacctctggatacaccgtcaccgacgaccatatatacgtgggtgcgacgacggccccgtggaacaaggccttgaggtggagtgggacatatcacgtccctgtcgaggtggtccgaccataaagttcacaaacgaagtaactttcgaggacgagggtcacatacgaccacgacacgtcatacaacacacacctacagtacggaacgtaggaaggggacgaccgtaaagactacgtacgaaccgacgtaccggttaccgtttaattagttcgtagaactaaattaaaggtaacttacgaaactaaacgttagttgttacgttttaagaagttaaggtacggggtacggggaaccgaaacggggttaactaacg

SEQ ID NO: 397871 - DNA, 731 bp, Homo sapiens
  misc_feature: GZ8MTXP01BNUXE.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcgagtcgtggggctggaggtagaagaacgccgtggggcctcgagtgaaggtctcctgacaacgcctctggactaccgaccgtcacccgacgaaccatatatacgtgggtcgcgacacggccccctaggaacaacggtccgttggagtggagtcgggacatacgtcacgtccctagtaccgaggtcggtacccgaccgtaacgtaaagtttcgaccgtaaaccgaaggttaaccgtttcgaaacgggaccgtaacggggtacccaacgtaaacgtacccgtaacccgtaaccggaacctaaccggtaccctaacgtaacccaaaacccgtaccgaacggttaaccccgaacaaggttaaccgggaaccgttaaggaacccgggggtaaacccgtaaacgggtaccttaacggtacgaaccggaacgttacccggttacgttttaagttagtacgttacggaactaaaagtaaagttacgttacgaccgtaaagtattcgttagtttagaataaggtggtacgggacgaaacggtcgaaccgttaagg

SEQ ID NO: 397872 - DNA, 663 bp, Homo sapiens
  misc_feature: GZ8MTXP01EZ1P1.13.33.C11.1.454.CMB.2.raw
  modified_base (184)..(184): a, c, t, g, unknown or other
  modified_base (239)..(239): a, c, t, g, unknown or other
  modified_base (256)..(256): a, c, t, g, unknown or other
  modified_base (275)..(275): a, c, t, g, unknown or other
  modified_base (305)..(305): a, c, t, g, unknown or other
  modified_base (432)..(432): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtncagtcgtggggctggaggtgaagagcctgggctcagtgagtctctgcaagcctcngatacaccgtcaccganaccatagtatacgtgggtncgacgacggcccctggacaaggccttaggngtggagtgggacatatcacgtccctgtccagtggtaccacctaactaaagttcgacctaaacgtaacgtaacgtttccgaagggtaccgacgggtccaacagtacgaacccacggtacaccgacaanacaaaccggcttacggaccctaacgagttacggaaacgttggaacggggggttacaaccgttaaaggacttaccgtacggaccgtaccgtaacgggtttacctttaaggttactttagggacctaacgtaaaattaaaggtaaaccccgtttaaacgaacgtaacgttacgttcgttacgtttaagtagttaacggtacgggtacgggttacggtaacggttaacgtaacg

SEQ ID NO: 397873 - DNA, 634 bp, Homo sapiens
  misc_feature: GZ8MTXP01C4KB5.13.33.C11.1.454.CMB.2.raw
  modified_base (276)..(276): a, c, t, g, unknown or other
  modified_base (461)..(461): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcgagtgaaggtctcctgacaagacctcgtggactacaccgtcaccgacgaccatanatacgtggtgcgacgacggcccctaggaacaaggccttgagtggagtaggacatatcacgccctgtcaggtggtccgaccaaagtaaagttcgacaaacgactaacgttacgaggtacgagggaccacgatccgaaccgacgacaccgacaactacaaacacacgaccctaagacgacggaaacnggaacggggacgaccgtaagactacgtagaaccgacgtaccgggttactttaagttactggactaactaaagttaaaggtaaccttaggaaacctaaaggttaacttcgttacgtttttaagaagttaacgggttggggaccgggttaaccgaaacggggttaaccctaacgg

SEQ ID NO: 397874 - DNA, 532 bp, Homo sapiens
  misc_feature: GZ8MTXP01CEPI9.13.33.C11.1.454.CMB.2.raw
  modified_base (132)..(132): a, c, t, g, unknown or other
  modified_base (372)..(372): a, c, t, g, unknown or other
  modified_base (415)..(415): a, c, t, g, unknown or other
  modified_base (441)..(441): a, c, t, g, unknown or other
  modified_base (510)..(510): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggntcccagatggggcctgtcccagctgcagctgcagggagtcgggcccaggagtggtgaagccttcggagacccctgtccctcagttgtaatgtgtctggtggctccctaagtaggactacttactactgggctggatccggcagcccccagggaaggctggagtggatggggatatcgtcttaatagtggagtacgaaactacaaatccgtcctcaagatcgagtcatcaaatatccgtanacaggtccagaacgaatctacctgaaagtgatctgtgacgtcncagacgacggctgttgtattatgtgngagagagaaatatgtagaggtgtcgacgttacgtcggcggacggtacgttacgttcgaccgtctcctcncgccaccaaccgaaccgaaccg

SEQ ID NO: 397875 - DNA, 509 bp, Homo sapiens
  misc_feature: GZ8MTXP02H2UC2.13.33.C11.1.454.CMB.2.raw
  modified_base (279)..(279): a, c, t, g, unknown or other
  modified_base (440)..(440): a, c, t, g, unknown or other
tcagtcacgtactacacgaccggtgctcgatttagagtgagctcgttgggtttgggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtncgacaggcccctggacaaggccttgagtggatgggacatatcagccctgtcagtggtgccacaaagtttgcacagactttcaggacagggtcaccatcgaccacggacacgtccatcaaacacagcctacatggaaactgaggagcctaagatctgacganacggcgtttaatatgtgacaataaagaattgacaaacgatgctttgatatgtagggccaagggactacg

SEQ ID NO: 397876 - DNA, 549 bp, Homo sapiens
  misc_feature: GZ8MTXP02GTK7K.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgccactaaagtttgcacagtaactttcgaggtacagggtcacatgaccacggacacgtccatacaaacacacgacctacataggaactggaggacgacctaagatctagaaccgacgacggtaccgtttaattacttgtagactaaataaaggaacttagactaaaacgaataggtacttttaggaattagtaggtaggggaaccg

SEQ ID NO: 397877 - DNA, 513 bp, Homo sapiens
  misc_feature: GZ8MTXP02IZXDS.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagaccctctggatacaccgtcaccgacgaccatatatactgggtgcgacaggcccctggacaaggccttgagtggatgggacatatcagccctgtcagtgtgccacaagtttgcacagactttcaggacagggtcacatgaccacggacacgtccatcaacacagcctacatgaactgagagactaagatctgacgacacggccgtttattatgtgacaataaagaattagactaaacgatgactttgattagtggtagggaccgaagggactaacg

SEQ ID NO: 397878 - DNA, 565 bp, Homo sapiens
  misc_feature: GZ8MTXP02HBL0V.13.33.C11.1.454.CMB.2.raw
  modified_base (219)..(219): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctnagtgaaggtctcctgcaagacctctggatacaccgtcaccgacgaccatatatactgggtgcgacacggcccctggacaaggccttgagtggatgggacagtatcagccctgtcaggtggtcgccacgtaaagtttgacacagtactttcgaggacagggtcacatcgaccacgacacgtcatacaacacacgcctaacataggaaactggaaacgggacgaccgtaaaggactacgtagaaccgacgaacggtccgtttaattagttgtacgtactaaagtaagtaaattgaactaaacgatgtactttgaattacgtaggtacggggaccgtaagggactaacg

SEQ ID NO: 397879 - DNA, 566 bp, Homo sapiens
  misc_feature: GZ8MTXP02H1X1J.13.33.C11.1.454.CMB.2.raw
  modified_base (455)..(455): a, c, t, g, unknown or other
  modified_base (516)..(516): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggccccctgtggtggtcatctatagggataataaaccggccctctgggatccctgaccgattctctggctccccaacgtccggggaacaccggccaccctcgcccatcaaaccagacgacccaaggaccggggatgaggctgactatttattgcagggtgtgggacaagcgaacccagggtnagtagtccgggcggcgggaaccaagcgtacgaccgtccgtaggtccacgcccgaacggccncgtcccccgtcggtccacgtccgtcgttcccgccctcctctacgtcgtcg

SEQ ID NO: 397880 - DNA, 527 bp, Homo sapiens
  misc_feature: GZ8MTXP02HGYOH.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtgtcgccacaaagtttgcacagactttcaggacagggtcacatcgaccacgacacgtccatacaacacacgacctacatcggaaactggaggagacctaagatctagacgacacgtcgtttatatgtgactaataagtaattacgacaaacgactagtctttaagattacgtggtagggaccgaagggactacg

SEQ ID NO: 397881 - DNA, 529 bp, Homo sapiens
  misc_feature: GZ8MTXP02FM29J.13.33.C11.1.454.CMB.2.raw
  modified_base (197)..(197): a, c, t, g, unknown or other
  modified_base (215)..(215): a, c, t, g, unknown or other
  modified_base (339)..(339): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattcccngtgagggaaacaaccttagaagtcagaatgtccactggtaccagcagaagtcaggccaggcccctgtggtggtcatctatagggataaataacccggccctcgtgggatccctgaccgtattcnctggctcccaacgtcggggaacacggccaccctgacccatcaaacagacgcccaaaggacgggatgaggctagactattatgtcaggtgtggacagcacacggtgatagtcggcgcggacaagctgaccgtcgaggtcacgccaagctcgcccctcgtcactcgtcgtcccgccctctctacgtacgtcg

SEQ ID NO: 397882 - DNA, 509 bp, Homo sapiens
  misc_feature: GZ8MTXP02FRXG2.13.33.C11.1.454.CMB.2.raw
  modified_base (418)..(418): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagacttcaggacagggtcacatgaccacggacacgtccatcaacacagcctacatgaactgaganccgtaagatctgacgacacggtcgttattatgtgacaagtaagaattgactaaacgatgtactttgatatggtgggaccaggggactaacg

SEQ ID NO: 397883 - DNA, 557 bp, Homo sapiens
  misc_feature: GZ8MTXP02JLUTJ.13.33.C11.1.454.CMB.2.raw
tcagtcacgtactacacgaccggtgctcgatttagagtgagctcgttgggtttgggatgctttctgagagtcatggatctcatgtgcaagaaaatgaagcacctgtggttcttcctcctgctggtggcggctcccagatggggcctgtcccagctgcagctacaggagtcgggcccaggagtggtgaagccttcggagacccctgtccctcagttgtaatgtgtctggtggctccctaagtaggactacttactactgggctggatccggcacgccccagggaagggctggagtggattggggatatctcttatagtggagtacgaactacaatccgtcctcaagagtcccgagtcatcatatccgtagacaggtccaaggaacgaattcctaccctagaaagtgagttctgtcgaccgtcgcagacacggctgtctattattgtgcgagacggacaaagtgtggttacgaggggtattcgacgtacgtggggaccacgggaaccctgggtaccaccggtctccgtacgacgccctaccaccgaacgggccctacgg

SEQ ID NO: 397884 - DNA, 555 bp, Homo sapiens
  misc_feature: GZ8MTXP02HQSSN.13.33.C11.1.454.CMB.2.raw
  modified_base (398)..(398): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttataggtgggagtacgaaactacaaatccgtaccctacaagacgtcgagtcatcatatccgtagacagtccaaggaacgaattcnccctagaaagtgaagttctgtgaccgtcgacagacacggctgtctatttatgtgcgagacggacaaatagtggttacgagggtagttcgacttacgcggggaccacggggtaaccctggtccaccgtcgtcctcacgcctaccaccgaacgggcccc

SEQ ID NO: 397885 - DNA, 544 bp, Homo sapiens
  misc_feature: GZ8MTXP02IK9XM.13.33.C11.1.454.CMB.2.raw
  modified_base (345)..(345): a, c, t, g, unknown or other
  modified_base (495)..(495): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtnaccacaaagtttgcacagtaactttcaggtacagggtcacatgaccacggacacgtaccatcaacaacagcctacataggaactgaggagacctaagatctgacgacacggtaccgtttattacttgtagtacaaagtaaagattacganaaaacgtaagttcggtacttttaggaattagttggttacggggaaccgg

SEQ ID NO: 397886 - DNA, 537 bp, Homo sapiens
  misc_feature: GZ8MTXP02IVLZ8.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagtacctctggatacaccgtcaccgacgaccatatatactgggtgcgacaggcccctggacaaggccttgagtggatgggacatatcagccctgtcagtggtcgccacaaagttgcacagactttcaggacagggtcacatcgaccacggacacgtccatcaaacacagcctacataggaactagaggacgacctaagatactagacgacgacggtaccgtttattattgtagtacaataaagaacttagactaaacgatcgtatttaagattaagtggtaggggacctaagggactaacg

SEQ ID NO: 397887 - DNA, 610 bp, Homo sapiens
  misc_feature: GZ8MTXP02HN1WI.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgcccccgagggaagggctggagtggagttggggatatctcttatagtgggagtacgaactacaatccgtccctacaagacgtcgagtcatcatatccgtagacaggtccaaggaacgaaattcctccctagaaagtgagttctgtcgaccgtcgcagacacggctgtcttatttatgtgacgagacggacaaaagtgtaggttacgaaggggtacgtttacggacgttacggtacgggggtacccgaaacgggggtaaccccgtacgggtccctaacccggttcctcccgttaccgaccggacccccttacccgaacccgaaaacggggtcccccg

SEQ ID NO: 397888 - DNA, 538 bp, Homo sapiens
  misc_feature: GZ8MTXP02GPZY1.13.33.C11.1.454.CMB.2.raw
tcagtcacgtactacacgaccggtgctcgatttagagtgagctcgttgggtttgggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactgggctggatccggcagcccccagggaaggggctggagtggatttggggatatctcttatagtgggagtacgaactacaaatccgtccctcaagacgtcgagtcatcatatccgtagacaggtccaggaacgaattctaccctagaaagtgaagttctgtgaccgtgcagacacggctgtctattatgtgcgagacggcaaatatggttcagggtagttcgacttacgtggggccaacggggaaccctggtccaccggtctcctcacgcctccaccgaggccc

SEQ ID NO: 397889 - DNA, 522 bp, Homo sapiens
  misc_feature: GZ8MTXP02HKM0L.13.33.C11.1.454.CMB.2.raw
  modified_base (281)..(281): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagaccctctggatacaccgtcaccgacgaccatatatactgggtncgacaggcccctggacaaggccttgagtggatgggacatatcagccctgtcagtgtcgccacaaagtttgcacagactttcagacagggtcaccatgacacgacactccatcaaacacagacctaacatagaacgagaggagaccgaagatatagacgacacggaccgtttattattagtgaacaataaataatatacaacgtatatattaagtagtagtaggtaggacgaacggacgacg

SEQ ID NO: 397890 - DNA, 526 bp, Homo sapiens
  misc_feature: GZ8MTXP02IHR2N.13.33.C11.1.454.CMB.2.raw
  modified_base (354)..(354): a, c, t, g, unknown or other
  modified_base (357)..(357): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtgtgcacaaagtttncanagaactttcaggtacagggtcaccgatgaccacggacacgtccatcaacacagcctacatagaactgaggagacctaagatctgacgacacgtccgttattactgtgactaaataagtaattagacaaaacgtaatagtacttttagaattagtagtacggggtaaccg

SEQ ID NO: 397891 - DNA, 543 bp, Homo sapiens
  misc_feature: GZ8MTXP02F0I2F.13.33.C11.1.454.CMB.2.raw
  modified_base (412)..(412): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagagcctggggcctcagtgaaggtctcctgcaagacctctggatacaccgtcaccgacgaccatatatactgggtgcgacaggcccctggacaaggccttgagtggatgggacatatcagccctgtccagtgtgccacaaagtttgcacagaacttcaggacagggtcacatcgaccacgacacgtccatacaacacacgcctanataggaactgaggacgacctaaagatactgaacgacgacggtacgtttattagttgtgactaaagtaaagaagttacgaacgaaaacgaagttacgtacttttagaagtttagtaggttacggggaaccgg

SEQ ID NO: 397892 - DNA, 529 bp, Homo sapiens
  misc_feature: GZ8MTXP02GUBVT.13.33.C11.1.454.CMB.2.raw
  modified_base (197)..(197): a, c, t, g, unknown or other
  modified_base (386)..(386): a, c, t, g, unknown or other
  modified_base (442)..(442): a, c, t, g, unknown or other
  modified_base (464)..(464): a, c, t, g, unknown or other
  modified_base (486)..(486): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccggganagacggccacaattccctgtgagggaaacaaccttagaagtcagaatgtccactggtaccagcagaagtcaggccaggccccctgtggtggtcatctataggggataataaccggccctctgggactccctgaccgattctctggctccccaactcggggaacacggccaccctgaccatcaacagacncccaagacggggatgaggctgactattatgtcaggtgtgggacagcaccgacggtnatagtcggcggcggaccaagcngacgtctaggtcagccaaggcncgccccgtcgtcactcgtcgtcccgcctcctctacgtacgtcg

SEQ ID NO: 397893 - DNA, 565 bp, Homo sapiens
  misc_feature: GZ8MTXP02JYK4B.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtgtcgcacaaagttgcacagactttcaggacagggtcacatcgaccacggacacgtccatcaacacacgcctacatacggaaactgaacggacaccgtaagactctagaccgacgaccgggtaccgtttaagttagttcgtaggtacctaaaagttaaagtaaagttagaactaaaacgtatacgttacttttaagaattagtcggttacggggaccgtaaggggactaacg

SEQ ID NO: 397894 - DNA, 521 bp, Homo sapiens
  misc_feature: GZ8MTXP02H44UR.13.33.C11.1.454.CMB.2.raw
  modified_base (285)..(285): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtncgacaggcccctggacaaggccttgagtggatgggacatatcagccctgtccagtggtgccacaaagtttgcacagtaactttcaggacagggtcacatgaccacggacacgtaccatcaaacacacgacctacataggaactgaggagacctaagatctagacgacacggtaccgtttattattgtagacaataaagaattagacaacgaatgtactttagatatgttacggacg

SEQ ID NO: 397895 - DNA, 562 bp, Homo sapiens
  misc_feature: GZ8MTXP02G7ZJB.13.33.C11.1.454.CMB.2.raw
  modified_base (316)..(316): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataagtaaccggccctntgggactccctgaccgattctctcggctccccaacgtccggggaacaccggccacccgtgaccatacaaacgagacgacccaaaggacggggatggagctagactattatgcgaggtgtaggacagcaccacggtgatacgtcggcggacggaccaagctggaccgtcctaggtccacgcccgaacggctccgcccccgtcggtaccaccgtcctcgttcccccgccctacctctaacgtcgtacg

SEQ ID NO: 397896 - DNA, 527 bp, Homo sapiens
  misc_feature: GZ8MTXP02JI8E3.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgccacaaagtttgcacagaacttcaggacagggtcaccatgaccacggacacgtccatcaacacacgacctacataggaactggaggacgacctaagactctagacgacgacggtaccgtttattacttgtgacaataaagattacgacaaacgaatagtactttagatagtaggtcgggaacg

SEQ ID NO: 397897 - DNA, 520 bp, Homo sapiens
  misc_feature: GZ8MTXP02IXMHO.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtcgccacaaagtttgcacagactttcaaggacagggtcacatcgaccacggacacgtcatcaacacagcctacatgaaactgaggagacctaagatctagacgacgacggtccgtttattattgtagtacaataagaattagacaaacgatgtactttgatagtggtagggccaagggactacg

SEQ ID NO: 397898 - DNA, 557 bp, Homo sapiens
  misc_feature: GZ8MTXP02GH3H1.13.33.C11.1.454.CMB.2.raw
  modified_base (373)..(373): a, c, t, g, unknown or other
  modified_base (462)..(462): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaagggctggagtggattggggatatctcttataggtgggagtacgaactacaatccgtcctacaagacgtcgagtcatcattatccgtanacaggtccaagaacgaattctccctagaaagtgaagttctgtcgaccgtgcagacacggctgtctattatgtgcgagacggacaaagtntggttacaggggtacgttcgacgttacgtcggggaccaacgggtaacccgtggtccaccggtctccctacacgtccctaccaccgaacgggtccc

SEQ ID NO: 397899 - DNA, 569 bp, Homo sapiens
  misc_feature: GZ8MTXP02GYA8K.13.33.C11.1.454.CMB.2.raw
  modified_base (280)..(280): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtncgacacggcccctggacaaggccttgagtggatgggacatatcagccctgtcaggtggtcgaccaactaaagtttgacaacagtactttcgaaggacgaggggtacacgatcgacccacggacaccgtaccataccaaacacacgacctacatacggaaactggaaggacgaccgtaaagactactagaaccgacgaccggtccgtttaattagttgtgtacaaataaagaattacgacaaacgatagtactttaaggattagtggtacgggaccgaaagggacctaag

SEQ ID NO: 397900 - DNA, 573 bp, Homo sapiens
  misc_feature: GZ8MTXP02F3HVZ.13.33.C11.1.454.CMB.2.raw
  modified_base (429)..(429): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagccgtggggcctcagtgaaggtctcctgcaagacctctggatacaccgtcaccgacgaccatatatacgtggtgcgacacggcccctggacaaggccttgagtggagtgggacatatcagccctgtccagtgtgaccaacgtaaagtttgcacagtaaacttcgaggacagggtcaccatcgaaccacggacacgtacactacaacacacgcctaanataggaaactgaaggacgacctaaagactacgtagaacgacgaacggtccgtttaattacgttgtacgaactaaagtaaacgtagtaacgaaacgtaaagtaagttacgttacgttagtagtaggtacggggtacggaaacggg

SEQ ID NO: 397901 - DNA, 590 bp, Homo sapiens
  misc_feature: GZ8MTXP02G6ENI.13.33.C11.1.454.CMB.2.raw
  modified_base (444)..(444): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcgagtgaaggtctcctgcaagacctctggatacaccgtcaccgacgaccatatatacgtgggtgcgacgacggcccctggacaaggccttgagtggatgggacatatcagcccgtgtcccagtggtcgaccaagtaaagtttgcacaacgtaactttcgaggtacgagggtcaaccagtacgaccacggacacgtacactacaaacacacgacctaanagtacggaactaggaacggacgaacctaaaggacttacacggaacgaccgtacggttaccgtttaattagttcgtagactaaataaacgtaagttacgacgtaaaagtaagtagtacgtttagattacgtagggtacgggaaccgg

SEQ ID NO: 397902 - DNA, 644 bp, Homo sapiens
  misc_feature: GZ8MTXP02JUWUE.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtagactacttactacgtgggctggatccggcacgcccccgagggaagggctggagtggagttggggatatctcttataggtggagtacgaactacaatcccgtaccctacaagacgtcgagtcatcattatccgtagacaggtaccaggaacgtaattcctacccgtagtaaagtgtaagttcgtgtacgtaccgtcgacaacgacgacgggcttggttaccttagtttaagttgtacggtacggaacgtaacgggtactaaaagttagttacggttacgaaggggtacgtttaccggtaacttacggtacgggggacccgtaacggggtaaccccgtcgggtaccctaacccggtcttaccccgtacgaccgtaccctacccgaaccggaaaccgggtcccccg

SEQ ID NO: 397903 - DNA, 562 bp, Homo sapiens
  misc_feature: GZ8MTXP02F7VCZ.13.33.C11.1.454.CMB.2.raw
  modified_base (418)..(418): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactacgtggggctggatccggcacgcccccgaggggaaggggctgggagtgggatttggggatatctcttatagtgggagtacgaactacaaatccgtaccctcaagagtcgagtcatcatatccgtagacaggtccagaacgaattcctccctagaaagtgagttcngtgaccgtgcagacacggctgtctattattgtacgagacgacaaatagtacggttgaggagttacggtactacgtagggccgaacgggacccgtacggtcaccggtcctccgtcgactccgtacccaccgaacggaccctaccg

SEQ ID NO: 397904 - DNA, 588 bp, Homo sapiens
  misc_feature: GZ8MTXP02HRBZL.13.33.C11.1.454.CMB.2.raw
  modified_base (393)..(393): a, c, t, g, unknown or other
  modified_base (446)..(446): a, c, t, g, unknown or other
  modified_base (449)..(449): a, c, t, g, unknown or other
tcagtcacgtactacacgaccggtgctcgatttagagtgagctcgttgggtttgggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgaatgtgtctggtggctccctaagtaggactacttactactggggctggatccggcagcccccgagggaagggctggagtggagttggggatatctcttatagtgggagtacgaactacaaatccgtaccctgaagagtcgagtcatcatatccgtagacaggtccaggaacgaattccnccctagaaacgtgaagttctgtcgaccgtcgcagacacggctgtctatttatntgntagacggacaaatgtggttacgagggtacgttcgacgttaacgtcgggggtaaccacggggtaaccccgtcgggtaccgaacccgttcccgtcccgttaccaacggtccctaccccgaacccgtaacggggtacccccg

SEQ ID NO: 397905 - DNA, 552 bp, Homo sapiens
  misc_feature: GZ8MTXP02GYK4Z.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggggctggaggtgaagaagcctggggcctcagtgaaggtctcctgcaagacctctggatacaccgtcaccgacgaccatatatacgtgggtgcgacaggcccctggacaaggccttgagtggatggggacatatcagccctgtccagtggtgccacaaagtttgcaacagtaaactttcaggacagggtcaccatgaccacggacacgtcatacaacacacgcctaacataggaactgaaggagacctaaagatactgaacgacgaacggtccgtttaattattgtagactaaagtaaagtaacttagaacaaaacgtaatagttactttagaattagttcggtacggggaaaccg

SEQ ID NO: 397906 - DNA, 568 bp, Homo sapiens
  misc_feature: GZ8MTXP02GXL1B.13.33.C11.1.454.CMB.2.raw
  modified_base (416)..(416): a, c, t, g, unknown or other
  modified_base (445)..(445): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgcccccgagggaagggctggagtggagtgggatatctcttagtagtgggagtacgaactaacaaatccgtcctacaagacgtcgagtcatcatatccgtagacaggtccaaggaaacgaattcaccctagaaagtgagttcngtcgaccgtcgcagacacgctgtctattntagtgcgagtacggacaaatagtggtcgaaggtacgttacgacgtacgtcggggaccaacgggtaaccctcggtaccacccgttcgcccgttcacggtccctaccgaaccgaacggggtcccc

SEQ ID NO: 397907 - DNA, 567 bp, Homo sapiens
  misc_feature: GZ8MTXP02JY1UW.13.33.C11.1.454.CMB.2.raw
  modified_base (464)..(464): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcacgcccccaggggaagggctggagtggagttggggatatctcttagtagtgggagtacgaactacaatccgtcctcaagacgtcgagtcatcatatccgtagactaggtaccagaacgaattcacccgtagaaagtgagttctgtcgaccgtcgacagtacacggctgtactattatgtgacgtagaccganaaagtgtggttacgagggtagttcgacttaggcggggaccgacgggtaacccgtggtccaaccggttcctcctacgacgtccctaccgaccgaacggtccccc

SEQ ID NO: 397908 - DNA, 526 bp, Homo sapiens
  misc_feature: GZ8MTXP02IGQN6.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagactttcaggacaggtcacatgaccacggacacgtcatcaacacacgcctaacatggaaactggaaggagcctaaagatctagacgacacggtaccgtttattattgtgactaaataaagaattagacaaaacgtatgacttttgattacgtgtaggggacaagggactaag

SEQ ID NO: 397909 - DNA, 541 bp, Homo sapiens
  misc_feature: GZ8MTXP02GADUR.13.33.C11.1.454.CMB.2.raw
  modified_base (511)..(511): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctcctgcaagacctctggatacaccgtcaccgacgaccatatatactgggtgcgacaggcccctggacaggccttgagtggatgggacagtatcagccctgtccagtggtgaccactaaagtttgcacaagtaactttcgaggacagggtcaccatcgaccacggacacgtacatcaacacagcctaacagtaggaactgaggacgaccgtaaagatctaggacgacgtacggtccgtttaattacttgtagactaaataagaattacgactaaacgtntagttactttagatagtggtacggggaacg

SEQ ID NO: 397910 - DNA, 505 bp, Homo sapiens
  misc_feature: GZ8MTXP02JLO9F.13.33.C11.1.454.CMB.2.raw
tcagtcacgtactacacgaccggtgctcgatttagagtgagctcgttgggtttgggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctgggggcctcagtgaaggtctcctgcaagacctctggatacaccgtcaccgacgaccatatatactgggtgcgacaggcccctggacaaggccttgagtggatggggacatatcagccctgtcagtgtcgccacaaagtttgcacagactttcaggacagggtcacatcgaccacggacacgtccatcaacacagcctacatggaactgaggagcctaaagatactagacgacacggaccgttatattgagcaatagattgacaacgatgactttgatatggtggacaaggacacg

SEQ ID NO: 397911 - DNA, 552 bp, Homo sapiens
  misc_feature: GZ8MTXP02IKPX1.13.33.C11.1.454.CMB.2.raw
  modified_base (349)..(349): a, c, t, g, unknown or other
  modified_base (361)..(361): a, c, t, g, unknown or other
  modified_base (387)..(387): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatggggacatatcagccctgtccagtggtgccgntaaagtttgcanagtaactttcgaggacagggtcacancgacacgacacgtacatacaacacagcctacatggaactgagagacctaaagactctgaacgacgaccggtacctttaagtttacttacgtagactaaagtaaagtaagttacgaacgaaaacgtaagttaggtacttttagactattgggtacggggtaaccgg

SEQ ID NO: 397912 - DNA, 545 bp, Homo sapiens
  misc_feature: GZ8MTXP02GU2KB.13.33.C11.1.454.CMB.2.raw
  modified_base (415)..(415): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatacgtgggtgcgacacggcccctaggacaaggccttgagtggatgggacatatcagccctgtcaggtggtcgccaacaaagtttgacacagacttcaggacagggtcacatcgaccacggacacgtcatacaacacagcctaanataggaactaggaggacacgtaagagtcacgacgacgacggtaccgtttatactgtagactaaataaagaattagactaaacgactagtatttaagagtagtaggtacgggtacgaacggggtactaacg

SEQ ID NO: 397913 - DNA, 566 bp, Homo sapiens
  misc_feature: GZ8MTXP02HMJ4R.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctcctgcaagacctctggatacaccgtcaccgacgaccatatatacgtgggtgcgacacggcccctggacaaggccttgagtggatgggacatatcagccctgtcagtggtcgccaactaaagtttcgacacagtactttcgaggaccagggtccacgatcgaccacgacacgtaccatccaaacacagacctacatacggaaactggaggacgtacctaaagatacgtagacgacgtaacggtccgtttaagttattgtacgtactaaaagtaaaggtaattagaactaaaacgattgtactttaagattagtacggtagggaccgaagggtactacg

SEQ ID NO: 397914 - DNA, 622 bp, Homo sapiens
  misc_feature: GZ8MTXP02I0EA1.13.33.C11.1.454.CMB.2.raw
  modified_base (316)..(316): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggacttacttactacgtgggctggatccggcagcccccagggaagggctggagtggattggggatatctcttanagtgggagtacgaacgtacaactcccgtaccctacgaagacgtacgagtcatcatactccgtagacacggtccaagggaacaattctaccctgaaaacgtgaagttctagttagaccgttcgacgacgacgacggcttagtctatttatgtgtaccgagacggactaaagtgtggttacaggggtagtttccggaacgttaccgtcgggggacccaacggggtaacccccgttcgggtacccgtaacccggtcttccccgtaccacggtacccccttacccgaacccgaaccgggggtaacccccg

SEQ ID NO: 397915 - DNA, 576 bp, Homo sapiens
  misc_feature: GZ8MTXP02HESVD.13.33.C11.1.454.CMB.2.raw
  modified_base (325)..(325): a, c, t, g, unknown or other
  modified_base (353)..(353): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaggccttgagtggatgggacatancagccctgccagtgtgccataaagtttncacagtaactttcgagtacagggtcacatcgaccacggacacgtccatacaacacacgacctacagtaggaactggaggacgacctaaagactacgtacgacgaccgaccgggtacgtttaacgtttaacttacggtagtactaaagtaaagtaaacttacggaacctaaaacgtaagttagtactttttaggaatttaggtacgggttacgggggaacccgg

SEQ ID NO: 397916 - DNA, 515 bp, Homo sapiens
  misc_feature: GZ8MTXP02IOZG8.13.33.C11.1.454.CMB.2.raw
  modified_base (490)..(490): a, c, t, g, unknown or other
tcagtcacgtactacacgaccggtgctcgatttagagtgagctcgttgggtttggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtggtgccactaaagtttgcacagtaaactttcaggtacagggtcaccgatgaccaggcacgtcatcaaacacagcctaacataggaactgaggagaccctaagatctgacgacgacgtcgtttatatgtgacaaataagattacgcaaaagntagttacttatatagtagtaggacg

SEQ ID NO: 397917 - DNA, 533 bp, Homo sapiens
  misc_feature: GZ8MTXP02JAAJ4.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgacacagactttcgaggacagggtcacatgaccacggacacgtcatcaacacagcctacatagaactgaggagcctaagatactagacgacacggtccgtttatattgtagactaataaagaattagacgtaaacgattagtctttaagattaagttggtaggggtaccgaaaggggactaacg

SEQ ID NO: 397918 - DNA, 575 bp, Homo sapiens
  misc_feature: GZ8MTXP02FO6RF.13.33.C11.1.454.CMB.2.raw
  modified_base (351)..(351): a, c, t, g, unknown or other
  modified_base (421)..(421): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacacggcccctggacaaggccttggagtggatgggacatatcagccctgtccagtggtgccaanaaagttgcacagtaacttcaggacagggtcaccatcgaccacggacacgtccatacaacacacgcctaanataggaactgaaggagacctaaagactacgtagaaccgacgaccgggtaccgttttaattaacgtttcggtagaacctaaaagtaaacgtaagttacgaacctaaaagtaagttagttacttttaggatttaacgttgggtacgggggaaaccg

SEQ ID NO: 397919 - DNA, 659 bp, Homo sapiens
  misc_feature: GZ8MTXP02HBSQL.13.33.C11.1.454.CMB.2.raw
  modified_base (198)..(198): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtcggccccggganagacggccacaattccctgtgaggaaacaaccttagaagtcagaatgtccactggtaccagcagaagtcaggccaggcccctgtggtggtcatctataggggataacgtaacccggcctcgtgggactcccgtgaccgattctctcggctccccgaacgtccggggaaaccaccgggcccacccgtacgacccactaccaaacagacgaccccgaaagggaccgggggaatggacggctaggaacttaatttagttggtacgtagggttggtagggacacggccgaaccgacgggtagaagttacggttccggggcggaccggggaccaacggcctacgggtacccgttcccgtaacgggtccgaccggacccgaaacgggcccgtaccggccccccgttacgggtcccaccgttccgttcccgttacccccacccgttccctaccgtacggtaccgtcgg

SEQ ID NO: 397920 - DNA, 549 bp, Homo sapiens
  misc_feature: GZ8MTXP02HYZE9.13.33.C11.1.454.CMB.2.raw
  modified_base (369)..(369): a, c, t, g, unknown or other
  modified_base (390)..(390): a, c, t, g, unknown or other
  modified_base (409)..(409): a, c, t, g, unknown or other
tcagtcacgtactacacgaccggtgctcgatttagagtgagctcgttgggtttgggatgctttctgagagtcatggatctcatgtgcaagaaaatgaagcacctgtggttcttcctcctgctggtggcggctccagatgggcctgtcccagctgcagctgcaggagtcgggcccaggagtggtgaagccttcggagaccctgtccctcagttgtaatgtgtctggtggctccctaagtaggactacttactactggggctggatccggcagccccagggagggctggagtggatggggatatctcttatagtgggagtacgaactacaactccgtaccctcaagacgtcgacgtcatcattatccgtanacagtccaggaacgaatttcnccctagaaacgtgagttcngttgaccgtcgcagacacggctgtctatttattgtgcgagacggactaaatagtggttacaggggtattcgacttacggtggggccgaacgggaccctggtccaccgtcctcctacgacgtcctaccgaccgaacggccc

SEQ ID NO: 397921 - DNA, 540 bp, Homo sapiens
  misc_feature: GZ8MTXP02II9ZW.13.33.C11.1.454.CMB.2.raw
  modified_base (281)..(281): a, c, t, g, unknown or other
  modified_base (341)..(341): a, c, t, g, unknown or other
  modified_base (416)..(416): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagccccactcccaggtgcagctggtgcagtctggggctgaggtgaagaagcctggggcctcagtgaaggtctcctgcaagacctctggatacaccgtcaccgacgaccatatatactgggtncgacaggcccctggacaaggccttgagtggatgggacatatcagccctgtcaggtggtcnccactaaagtttgacacagactttcaggacagggtccacgatcgacccaggacacgtccatacaacacagcctanatggaactgaaggagacctaagatctagacgacgacggtacctttattagtgtgaactaataagaacttagacaaacgtaatcgtactttaagattagtcggtacgggtacgaagggactaacg

SEQ ID NO: 397922 - DNA, 528 bp, Homo sapiens
  misc_feature: GZ8MTXP02JZEHS.13.33.C11.1.454.CMB.2.raw
  modified_base (364)..(364): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtccagtgtgcacaaagttgcacagaacttnagacagggtcaccatgaccacgacacgtcatcaacacagcctaacataggaactgaggagacctaaagatctgacgacgtacggtaccgtttaattagttgtagactaaataacgaattcgacaaacgaatacgtacttttagagtacgtggtacggggaccgg

SEQ ID NO: 397923 - DNA, 540 bp, Homo sapiens
  misc_feature: GZ8MTXP02G9R7N.13.33.C11.1.454.CMB.2.raw
  modified_base (376)..(376): a, c, t, g, unknown or other
  modified_base (410)..(410): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagagccgtggggcctcagtgaaggtctcctgcaagacatctggatacacgtcaccgacgaccatatatacgtgggtgcgacaggcccctggacaaggccttgagtggatgggacagtatcagcctgtcagtgtgacaacaaagttgacacagtaactttcgaganagggtcacatgacacgacacgtcatacaacacanactacatagactgaggagcctaagatacgagacgacgacgggtcctttaattagttagcggtataaactaaagtaacgttaagaaacgtaaagtagttacgttactttagtagtacggtacgggtacggg

SEQ ID NO: 397924 - DNA, 723 bp, Homo sapiens
  misc_feature: GZ8MTXP02IV3VW.13.33.C11.1.454.CMB.2.raw
  modified_base (286)..(286): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtgggctggaggtgaagaagccgtggggcctcgagtgaaggtctcctgacaagacctctggactacaccgtcaccgacgaccatatatacgtgggtnacgacgacggcccctaggaacacggccgttagaggtggagtggaactagtactcacgccctgtcaggtggtcgacctaacgtaaagtttcgacaacgaacgtacgtttacgaacgggtaacgacggggtccaaaccgatcggaaacccgaacgggaacctaaccggtacccaactaaccaaaaccgaccaacgacccctaacgaagttacgggaaaaccgttaggaaacgggaaacgtacccgtaaaaggacgttaaccgtaacggaaccgtaaaccgtaacggggtttacccttttaaagtttacgtttacggtaacgaaactaaaagttaaaggtaaactttaacgaaacgttaaaaccgtaaagtttccgttaaggtttttaaacgtaagttaacgggtacggggtaacgggtaaccggtaaacggtactaacg

SEQ ID NO: 397925 - DNA, 517 bp, Homo sapiens
  misc_feature: GZ8MTXP02IX3W1.13.33.C11.1.454.CMB.2.raw
  modified_base (437)..(437): a, c, t, g, unknown or other
  modified_base (500)..(500): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatggggacatatcacgccctgtccagtggtgccactaaagtttgcacagtaaactttcaggacagggtccaccatgaccacggacacgtcactcaaacacagcctaacatggaactgagganacctaagatctagaacgacaacgccgtttattactgtagacaaataagattagcaaagaatgntttagatatgtaggacg

SEQ ID NO: 397926 - DNA, 613 bp, Homo sapiens
  misc_feature: GZ8MTXP02H7CZA.13.33.C11.1.454.CMB.2.raw
  modified_base (210)..(210): a, c, t, g, unknown or other
  modified_base (420)..(420): a, c, t, g, unknown or other
  modified_base (445)..(445): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggccaggagtggtgaagccttcggagaccctgtccctnagttgtaatgtgtctggtggctcctaagtaggactacttactacgtgggctggatccggcacgcccccgagggaacgggctggagtggagttggggatatctcgttataggtgggagtacgaaacttacaatcccgtacctcaagacgtcgagtcatcatactcgtagacaggtaccaaggaacgaattcaccctagaaacgtgtagtcngtacgaccgtcgactacgacacggntgtactatttaatgtacgacgtagaacggactaaaagtagtaggttacgagggggtaactttcgaacgttacggtacgggaccgaacggggtaaccccgtcggttacccgaacccggttcctcccgtaccgacggtaccctaccccgaaccggtaaaccgggcccccg

SEQ ID NO: 397927 - DNA, 618 bp, Homo sapiens
  misc_feature: GZ8MTXP02GWIPB.13.33.C11.1.454.CMB.2.raw
  modified_base (351)..(351): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcaggtgcgccactaaagtttncacagtactttcaggacagggtccacatcgaccacggacacgtccatacaaacacagacctaacagtaggaaactggaaggacgtaccgtaaagactacgtacgaaccgacgtaaccgggttaccgttttaagttacgtttagtacggtaacctaaaagttaaaggtaaagtttacggaaaccgtaaaacgtagtacgttaccgttttaaggtaactttaaggttacggggtacgggggtaacccgtaaagggtaaccgttaaacgg

SEQ ID NO: 397928 - DNA, 524 bp, Homo sapiens
  misc_feature: GZ8MTXP02F08ST.13.33.C11.1.454.CMB.2.raw
  modified_base (434)..(434): a, c, t, g, unknown or other
  modified_base (499)..(499): a, c, t, g, unknown or other
  modified_base (508)..(508): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcgagtgaaggtctcctgcaagacctctggatacaccgtcaccgacgaccatatatactgggtgcgacaggcccctggacaggccttgagtggatgggacatatcagccctgtccagtgtgccataaagtttgcacagtaacttcaggacagggtcaccatcgaccaggacacgtaccatacaacacacgcctaacataggaactgaggganacctaaagatactagacgacacgggtctttaatacgttgtacgactaaataagaattgacaaagntgtatttanatatcggtacggaacg

SEQ ID NO: 397929 - DNA, 587 bp, Homo sapiens
  misc_feature: GZ8MTXP02FKJUQ.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactacgtggggctggatccggcacgcccccgagggaggggctgggagtggagttggggatatctcttagtaggtgggagtacgaactacaatcccgtcctcaagacgtcgagtcatcatatccgtagacaggtccaaggaacgaattctaccctagaaagtgtagttctgtcgaccgtcgacagacacggctgtactattagttgtgcgagacggactaaaagttagtggttacgaggggtagttccgacgttacgcgggggtacccgaacggggaacccttcgggaccacccggttcctcccgtccgacgtccctcccgaaccgaaccggggcccc

SEQ ID NO: 397930 - DNA, 602 bp, Homo sapiens
  misc_feature: GZ8MTXP02IWNAG.13.33.C11.1.454.CMB.2.raw
  modified_base (223)..(223): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctnagtgaggtctcctgcaagacctctggatacaccgtcaccgacgaccatatatactgggtgcgacaggcccctggacaaggcctgagtggatgggacatatcacgccctgtcccagtggtcgaccaataaagtttgcacaagtaaacctttcgagggtacaggggtccaaccgatacgacccgacggacaccgtacactacaacacacgcctacataggaactggaggacgacctaagactactacgaacgacgtaaccggttaccgtttaagtttagttacggtacggaacctaaaagttaaaacgtaagtttacgaaccgtaaaacgtaagttagttacgttttagaagtttaacgtggggttaacggggtaaaccgg

SEQ ID NO: 397931 - DNA, 536 bp, Homo sapiens
  misc_feature: GZ8MTXP02IR0GF.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcagtggtgccacaaagtttgcacagactttcaggacagggtcacatgacacgacacgtcatcaacacagcctacatagaactgagagacgtaagatctgacgacgacggccgtttattattgtagtacaataaagaatttagacgtaaaaccgtagttagtacttttaaggattaacgtggttacggggaccaaggggaactaacg

SEQ ID NO: 397932 - DNA, 687 bp, Homo sapiens
  misc_feature: GZ8MTXP02FQAIX.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgtaatgtgtctggtgctccctaagtaggactacttacacgtggggctggatccggcacgcccccgagggaacgggctgggagtggagttggggatatctcttagtagtgggatacgaactactaactccgtcctacaagacgtacgagtcatcattactccgtagactaggtaccaaggaacgtaacttcctacccgtagaaaacgttgtaacgtttcgtagttacggacccggttacgacgtaacggaccgaaccggggtcctttaggtacctttaagtttagtttcgggttacggacggtaacggaaccgggtaactaaaagtttagtacgggtttagaagggggttacgtttaccggaacgttacggttacgggggacccgtaaacgggggtaacccccttggggtacctaaccccgggttccttcccgtacgaccggccccttaccgaaccccggacggggtacccccg

SEQ ID NO: 397933 - DNA, 640 bp, Homo sapiens
  misc_feature: GZ8MTXP02H0V6I.13.33.C11.1.454.CMB.2.raw
  modified_base (249)..(249): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggggctgaggtgaagaagcctggggcctcagtgaaggtctcctgcaagacctntggatacaccgtcaccgacgaccatatatactgggtgcgacacggcccctggacaaggccttgagtggatgggacatatcacgcctgtccagtggtgaccaactaaagtttcgcacagtaactttcgaaggcagggtcaccatcgaccacgacacgtcatacaacacagacctaacagtacggaaactaggacgggtacgacccgttaaaggacttacgtacggaaaccgacgtaaccgggtaccgtttttaagtttaacgttggttacgtaaaccgtaaaaagtaaaacggttaagttaacggtaaaccctaaaaacggtaacgtttaggttaaccgttttttaggaaacgtttaacggtttagggggtttaacgggggtaaaacccggg

SEQ ID NO: 397934 - DNA, 566 bp, Homo sapiens
  misc_feature: GZ8MTXP02HX1WY.13.33.C11.1.454.CMB.2.raw
  modified_base (411)..(411): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacacggcccctggacaaaggccttgagtggatggggacatatcagccctgtcagtggtcgaccactaaagtttgcacagactttcgaggacagggtcaccatgaccacggacacgtccatacaacacanacctaacatagaactggaagagacctaaaggatctagacgacgacggaccgtttatattgtacgtacaaataaacggaaatttacggacctaaaaacggtacttacgttacgtttaagtacttagtacggtacgggaccggaaacggtactaacg

SEQ ID NO: 397935 - DNA, 576 bp, Homo sapiens
  misc_feature: GZ8MTXP02IRBYB.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagccgtggggcctcagtgaaggtctctgcaagacctctggatacaccgtcaccgacgaccatatatactggtgcgacacggcccctggacaaggccttgagtggatgggacatatcacgccctgtccaggtggtcgacctaactaaagtttcgcacaacgtaacctttcgagggacaggggtcaccatcgaccacggacacgtacactacaacacacgcctacagtaggaacgtgaggaggacctaagactacgtagaacgacgtacgggtaccgtttaagttacgtttgtacgactaaaataaacgtaagttacgactaaaacgtaagtacgtacttttagagttacgtagggttacgggaaccg

SEQ ID NO: 397936 - DNA, 552 bp, Homo sapiens
  misc_feature: GZ8MTXP02I8GGI.13.33.C11.1.454.CMB.2.raw
  modified_base (464)..(464): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtggactacttactactgggctggatccggcagcccccagggaagggctggagtggattggggatatctcttatagtgggagtacgaactacaaatccgtccctcaagacgtcgagtcatcatatccgtagacaggtccaggaacaattctaccctgaaacgtgagttctgtgaccgtcgctagacacggctgtctattatgtgcgagacggacaaatatggttanaggggtattcggacttacgtcgggggaccacgggtaacccctgggtccacccgtctccgtcaacggcctaccaccgaagggtcccccg

SEQ ID NO: 397937 - DNA, 646 bp, Homo sapiens
  misc_feature: GZ8MTXP02HSL88.13.33.C11.1.454.CMB.2.raw
  modified_base (242)..(242): a, c, t, g, unknown or other
  modified_base (280)..(280): a, c, t, g, unknown or other
  modified_base (284)..(284): a, c, t, g, unknown or other
  modified_base (417)..(417): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagcctggggcctcagtgaagtctctgcaagacctntggatacaccgtcaccgacgaccatatatacgtgggtncganacggcccctaggacaaggccttgagtggatgggacatatcagccctgtcagttggcgcccaataaagtttcgacaccgaagtacctttcgaaggaacacgggggtaccaaccgatacgaccacggacacgcanacaacacagacctacagtacggaaactggaaaggacgtaccgttaaagaacgttcgtaacggaaccgaccgtaacggggtacccttttaagtttaaacgtttcggtaggtaacctaaaagttaaaacgtaaaacgtttaggtaaacaaaaaaccggttacgttacggttacgtttaagtagttaacggttacggggtaacggggtaaccggtaaacgggtaactaacgg

SEQ ID NO: 397938 - DNA, 587 bp, Homo sapiens
  misc_feature: GZ8MTXP02IUKYY.13.33.C11.1.454.CMB.2.raw
  modified_base (346)..(346): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctagtagactacttactactgggctggatccggcagcccccgagggaaggggctggagtggagttggggatatctcttatagtgggagtacgaactacaactccgtccctanaagacgtcgagtcatcatatccgtagacaggtccaggaacgaattctaccctagaaagtgagttctgtgaccgtgcagacacgctgtctattatgtgcgagacggacaaagtagtggttacgaggggtacgttacggacgttaacggtcgggggtacccaacgggggtaacccctcgggtcccgtaaccggttccttcccgtaccgaccggtcccctacccgaccgaaaccggggtccccc

SEQ ID NO: 397939 - DNA, 568 bp, Homo sapiens
  misc_feature: GZ8MTXP02F4ICJ.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaggtctctgcaagacctctggatacaccgtcaccgacgaccatatatactgggtgcgacaggcccctggacaggccttgagtggatgggacatatcagccctgtcccagtggtgccacaaagtttgcacagtaacttcaggacagggtcaccatcgaccacggacacgtaccataccaaacacacgcctacatacggaactggaggacgccgtaaagactacgtagaacgaccgacgggtaccgttttaattacgtttaggtacgactaaagtaaacgtaaagtttacgacgtaaaaccgaagtagtacttttagagttaagtcggttacggggaaccgg

SEQ ID NO: 397940 - DNA, 553 bp, Homo sapiens
  misc_feature: GZ8MTXP02HO46R.13.33.C11.1.454.CMB.2.raw
  modified_base (223)..(223): a, c, t, g, unknown or other
  modified_base (242)..(242): a, c, t, g, unknown or other
  modified_base (450)..(450): a, c, t, g, unknown or other
  modified_base (525)..(525): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctnagtgaagtctctgcagctntggatacaccatcaccgacgaccatatatactgggtgcgacaggcccctggacaaggccttgagtggatgggacagtatcagtccctgtcagtggtcgcaacgtaaagtttggactaacgagtaacctttacgaagggacaggggtacaccgagtcgaaccgacggacacgtccataccaacacagacctacagtacgaactgagganacctaagatacacgacgacgtacggtacgtttacttagttgtagactaaagtaacgaatttacgaactaaacgtntacgtactttagattagtaggtacgggg

SEQ ID NO: 397941 - DNA, 553 bp, Homo sapiens
  misc_feature: GZ8MTXP02GNMZP.13.33.C11.1.454.CMB.2.raw
  modified_base (283)..(283): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaggtctcctgcaagacctctggatacaccgtcaccgacgaccatatatactgggtncgacaggcccctggacaaggccttgagtggatgggacatatcagccctgtccagtgtgccacaaagtttgcacagaactttcgaggacagggtcaccatgacacggacacgtaccatcaacacacgcctacataggaactggaggagcctaaagatctgaacgacgaaccggtccgtttaattacgttgtagtactaaaataacggtaacttaggaccaaaacggtaatacggtacttttaggaattaagtggttacgggggaaacccgg

SEQ ID NO: 397942 - DNA, 623 bp, Homo sapiens
  misc_feature: GZ8MTXP02G4VWF.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcagtgaaggtctcctgcaagacctctggatacaccgtcaccgacgaccatatatacgtgggtgcgacacggcccctggacaggccttgagtggatgggacatatcagccctgtcaggtggcgaccataaagttcgacacagtacttcgaggacgaggtccacagtcgacccgacggaccacgtcatacaaacacacgacctaacgagttacggaaacgtggaaacggtacggtaccctaaaggtacttacgtaacggaaccggtaaccgtaaccggggttacccgttttaaattacgtttagggtactaaactaaaagtaaaggtaattacggaactaaaacgtagttcgttactttaagaagttagtacggggtacgggaaccgaaacggggtactaacgg

SEQ ID NO: 397943 - DNA, 586 bp, Homo sapiens
  misc_feature: GZ8MTXP02IQIG3.13.33.C11.1.454.CMB.2.raw
  modified_base (445)..(445): a, c, t, g, unknown or other
  modified_base (457)..(457): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtagactacttactactgggctggatccggcacgcccccagggaaggggctggagtggagttggggatatctcttatagtggagtacgaactacaatccgtcctcaagagtcgagtcatcatatccgtagacagtccaggaacgaattcctaccctagaaagtgaagttcgtgtcgacgtcgcgagacacggctgtctattattgngacgagacgganaaagtatggttacgaggggactttcggacgttaaggtcggggaccgtaacggggacccttcggggtacctaacccggttccgtcccgttaccgaccggacccttacccgaacccgaacgggtacccccg

SEQ ID NO: 397944 - DNA, 535 bp, Homo sapiens
  misc_feature: GZ8MTXP02FZUO6.13.33.C11.1.454.CMB.2.raw
tcagtcacgtactacacgaccggtgctcgatttagagtgagctcgttgggtttggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaggtctcctgcagacctctggatacaccgtcaccgacgaccatatatactgggtgcgacaggcccctggacaaggccttgagtggatgggacatatcagccctgtcccagtggtgccacaaagtttgcacagtaactttcgaggacagggtcaccatcgaccacggacacgtccatacaaacacacgcctacataggaactgaggagacctaagatctagacgacgacggtcgtttattacttgtagactaaataagtaattacgacgaaaacgaatacgtacttttagattagtaggtacgggaaccg

SEQ ID NO: 397945 - DNA, 549 bp, Homo sapiens
  misc_feature: GZ8MTXP02GE8YY.13.33.C11.1.454.CMB.2.raw
  modified_base (199)..(199): a, c, t, g, unknown or other
  modified_base (218)..(218): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcggccccggganaggacggccacaattcccngtgaagggaaacaaccttagaagtcagaatgtccactggtaccagcagaagtcaggccaggcccctgtggtggtcatctataggggataataaccggccctctggggactccctgaccgtattcctctggcctccccaacgtccggggaacaccggccaccctgacccatccaaacagacgacccaaaggcggggatgaggctgactatatgtcaggtgtgggacaggcaccgaggtgatagtcggcggcgggacaaggctgacgtctaggtcacgccaaggcctcgaccccctcggccactcctcgtcccaccctcctctacgtcgtacg

SEQ ID NO: 397946 - DNA, 594 bp, Homo sapiens
  misc_feature: GZ8MTXP02H7ZB9.13.33.C11.1.454.CMB.2.raw
  modified_base (208)..(208): a, c, t, g, unknown or other
  modified_base (418)..(418): a, c, t, g, unknown or other
  modified_base (422)..(422): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctccagatggggcctgtcccagctgcagctgcaggagtcgggccaggagtgtgaagccttcggacaccctgtccctnagttgtaatgtgtctggtgctcctaagtagacttacttactactggggctggactccggcacgcccccgagggaacggggctggagtggtagtgggatatctcttagtagtgggatacgaaactacaaatcccgtcctacgagacgcgagtcatcatactcgtagacacggtccaagaacgaatttccacccttagaaacgtgtagttcngtanaccgttcgactacgacgacggcttgtacttagtttatgtagcgaagacggactaaagtcgttaggtacgaggggtagtttccgacgttaccgggtggtacccgaacggggtaaaccctcgggtacctacccgttccgtcctacgtacggccctacccaccgtaacggccccg

SEQ ID NO: 397947 - DNA, 567 bp, Homo sapiens
  misc_feature: GZ8MTXP02F63FH.13.33.C11.1.454.CMB.2.raw
  modified_base (411)..(411): a, c, t, g, unknown or other
  modified_base (432)..(432): a, c, t, g, unknown or other
  modified_base (489)..(489): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctctgcaagacctctggatacaccgtcaccgacgaccatatatacgtgggtgcgacacggcccctggacaaggccttgagtggatgggacatatcagccctgtcagtggtcgaccactaaagtttgacacaagtacttcaggacagggtcaacagtacgaccacggacacgtacactacaaacnccaagacctacaatggaaacngaaacggagaccttaagacttacagacgacgtacggtaccgtttaattactggtaanaactaaagtaaagtatacgaaactaaacgtacttacgttattaagtagttacggtacggacggtaacgaacggactag

SEQ ID NO: 397948 - DNA, 618 bp, Homo sapiens
  misc_feature: GZ8MTXP02GNZXO.13.33.C11.1.454.CMB.2.raw
  modified_base (346)..(346): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctcctaagtaggactacttactacgtgggctggatccggcacgccccgagggagggctggagtggagttggggatatctcttagtagtggagtacgaactactactccgtacctanaagcgtcgagtcatcatatcgtagacaggtaccaggaactaattcctaccgtagtaaagtgtaacgttcgtagtacgaccgtcgacgtaacgaccgacggtctagttaccttaagtttgttaggttacgacggaagaaccgggtactaaaagttaggtacggttaacggaaggggtacgttacggacgttaacgggtcggggaaccgtacgggtaacccgtcggtacctaccggtcctccgtcaccgccctaccgaacccgacgggtacccc

SEQ ID NO: 397949 - DNA, 722 bp, Homo sapiens
  misc_feature: GZ8MTXP02JM220.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcgagtgagtctctgcagacctgtgatacaccgtcaccgacgaccatatatacgtgggtcgcgacgacggcccctagggaaccgaacggtccttaggaggttagggaacgttaggggaacctagttactacgacgccccgttgtaccccgtaggttacgggtacgaccctaaacgttaaaacggtttcgaccgtaaacgaaacggttaaacctttaccggaagggtaaccggaacggggttacccaaaccgtacgtaccggaacccgaacgggaaccaacccggttaccaactacccgaaaaccgaccaacgtaccctaaagaacgttaacgggaaccgtaggaacgggtaacgtacccgtaaagcgtacgtacggaacgtaaccggtaccgggttacctttaagttaacgtttaggtacgtaaactaaagtaaacgtaacgttacgaacgtaaacgtaagtacgttactttagattacggtaggtacggggaaccg

SEQ ID NO: 397950 - DNA, 546 bp, Homo sapiens
  misc_feature: GZ8MTXP02FJ95W.13.33.C11.1.454.CMB.2.raw
  modified_base (244)..(244): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccagggctggtgaagccttcgacgaccctgtccctcacttgcactgtctcaggtgctccattaaaaccngcagttatcacgtggggtgatccggcgacgcccccggggaagagcgtggagtggagtggggagtatttatatactggcaatacttacgacaatccgtacctacaagagtcgatcaccctgtccgtgacacgaccgaataaccagttcctccctgacgcctagacctctgtcgaccgccgcgactcgacctatacttctgtgacgagacgatacgagatgtgtcagtcggcgggtctacgttttgattacgtcgtcgggggacctaaggggtccgtaagtcgggtactacgttcgtctttccg

SEQ ID NO: 397951 - DNA, 573 bp, Homo sapiens
  misc_feature: GZ8MTXP02GFGG9.13.33.C11.1.454.CMB.2.raw
  modified_base (313)..(313): a, c, t, g, unknown or other
  modified_base (455)..(455): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactacgtggggctggatccggcacgcccccgagggacgggctggagtggagtgggatatctnttatagtggatacgaactacaactccgtcctacgaagacgtacgagtcatcatatccgtagacaggtaccaaggaacgaaattcctaccctagtaaaacgtgagttctgtacgaccgtgcagacacggctgtctattagtgngtacgagacggacaaagtgtggtacgagggtagttacgacgtgtcggggacgaacgggaccctcgggtacctaccggtctccgtacgaccgcccttaccgaacccgaacgggtccccc

SEQ ID NO: 397952 - DNA, 638 bp, Homo sapiens
  misc_feature: GZ8MTXP02G55PD.13.33.C11.1.454.CMB.2.raw
  modified_base (288)..(288): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtggggcctcagtgaaggtctcctgcaagcctctggataccaccgtcaccgacgaccatatatacgtgggtgcgacncggcccctggacaaggccttaggaggtggagtgggactagtatcgagcccgtgtcaggtggtacgacctaacgtaaagttcgactaacgaacgtacctttcgaaggaccgtacggggtaccaaccgtagtacgacccgacggaccacgtaccataaccaacacacgacctaacagtacggaactaggaacggacgtacgtaaagtactacgtacggaaccgacgtacggttaccgtttaattacgttagtacgtaactaaaagttaaaggtaattacgaaactaaacggtacttagttacgtttaagaagtagttacggggtacggggaacccgtaaggggacctaacgg

SEQ ID NO: 397953 - DNA, 564 bp, Homo sapiens
  misc_feature: GZ8MTXP02F4NNQ.13.33.C11.1.454.CMB.2.raw
  modified_base (280)..(280): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtncgacaggcccctggacaaggccttgagtggatgggacatatcagccctgtcagtggtcgccactaaagttgcacagtacttcaggtacagggtcaaccatcgaccacggacacgtccatacaacacacgacctaacataggaaactggaagggacgacctaaagactactacgacgacgacggtaccgtttattacgttgtagtactaaataaagtaatttaggaacaaaacgtactaggtacttttaagattaagtcggtaggggaccgaaggggtactaacg

SEQ ID NO: 397954 - DNA, 594 bp, Homo sapiens
  misc_feature: GZ8MTXP02IX18S.13.33.C11.1.454.CMB.2.raw
  modified_base (248)..(248): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctntggatacaccgtcaccgacgaccatatatacgtgggtgcgacaggcccctggacaaggccttagagtggatgggacatatcagccctgtccaggtggtcgacctaacgtaaaggtttgactacgaagtaacctttacgaagggtacgaggggtaccaaccgatacgaacccacgggaacaccgtaccatacaacacagacctacatggaactggaaggacgacctaagactactaggaacgacgtaccggttacctttaattacgttgtacgaactaaagtaacgtaagttacgaacgtaaaacgtaatagttacttttagaattacggtaggttacggggaaccg

SEQ ID NO: 397955 - DNA, 534 bp, Homo sapiens
  misc_feature: GZ8MTXP02JFECT.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagagcctggggcctcagtgaaggtctcctgcaagacctctggatacaccgtcaccgacgaccatatatactgggtgcgacaggcccctggacaggccttgagtggatgggacatatcagccctgtccagtgtcgccactaaagtttgcacagaacttcgaggacagggtcacatcgaccacggacacgtccatacaaacacacgcctacagtaggaactaggaggacgacctaaagactcgtacgacgacgaacggtcctttaagttactgtagacaaataagaattacgacaaacgaagtgtactttgattagtaggtagggaccg

SEQ ID NO: 397956 - DNA, 576 bp, Homo sapiens
  misc_feature: GZ8MTXP02HV545.13.33.C11.1.454.CMB.2.raw
  modified_base (427)..(427): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagagcctgggcctcagtgaaggtctctgcagacctctggatacaccgtcaccgacgaccatatatacgtgggtgcgacaggcccctaggacaaggccttgagtggatgggacatatcgacgcctgtcccaggtgtcgccaataagtttgcacaagtaactttcgaaggacgagggtaccacatacgaccacggacacgtacactacaacacacgcctaanagtagaactaggaggacgacctaaagatacgtacgacgaccgacggtaccgtttaattacgtttagtagtactaaagttaaacgtaaagttacgaactaaacgtaagttagtacgttttagaagtttagtacggttacggggaaaccgg

SEQ ID NO: 397957 - DNA, 623 bp, Homo sapiens
  misc_feature: GZ8MTXP02HMSS6.13.33.C11.1.454.CMB.2.raw
  modified_base (420)..(420): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgtaatgtgtctggtggctccctaagtaggactacttactactgggctggatccggcagcccccagggaagggctggagtggagttggggattagtctcttagtaggtgggagtacgaactacaactccgtccctacgaagacgtcgagtcatcatactccgtagacgaggtaccaggaacaattctaccctagaaacgtgagttcngtgaccgtcgctagacacggctgtactattatgtagcgtagaccggataaagtagtggttacgagggtacgtttacgacttacggtacggggtaccgaacgggggtaacccccgtagggttaccccaaacccgggtttccttaccccgtaccgtaaccggtacccccttacccccgtaacccggaaaaccgggggttcccccc

SEQ ID NO: 397958 - DNA, 579 bp, Homo sapiens
  misc_feature: GZ8MTXP02IZH92.13.33.C11.1.454.CMB.2.raw
  modified_base (400)..(400): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagccccactcccaggtgcagctggtgcagtctggggctgaggtgaagagcctgggcctcagtgaaggtctctgcaagcctctggatacaccgtcaccgacgaccatatatactgggtgcgacaggcccctggacaaggccttgagtggatgggacatatcagccctgcagtggtcgccacaaagtttgacacagactttcgaggacagggtcaccatcgaccacggacacgtcatcaaacncagcctacatggaactgaggagacctaagatctagacgacgaccggtaccgtttattaacttgtacggactaaaagtaaacggtaaatttacggaaactaaaacggtaattcggtactttttaaggaaactttaaggttacgggtacgggggtaacccgaaagggggaaccttaaccgg

SEQ ID NO: 397959 - DNA, 616 bp, Homo sapiens
  misc_feature: GZ8MTXP02JPS33.13.33.C11.1.454.CMB.2.raw
  modified_base (543)..(543): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagaagccgtggggcctcagtgaaggtctcctgcaagacctctggatacaccgtcaccgacgaccatatatacgtgggtgcgacgaggcccctggacaaggccttgaggtggatgggacatatcacgcctgtccgagtggtcgaccacgtaaagtttgcctaactaacgtaacctttacgaagggtaacgaggggtaccaaccgagtacggacccaacgggaccaaccgtaccactaccaaacaccacgaccctaacacgttaggaacctggaacgggacgtaaccgtaagacgtacgtacggacgaaccgtacggtacctttaattacgttagtntaacgtaaattaagtaagttacgacgtaaaacgtgtacgttactttagattaggtacgggtacgggtaaccgg

SEQ ID NO: 397960 - DNA, 729 bp, Homo sapiens
  misc_feature: GZ8MTXP02IKZAD.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctaggaggtagaagaacgccgtcgggcctcgagtagaaggtctcgtgacaacgacctcgtagactacgaccgtcaccgaccgaccatatatacgtgggtcacgacgccggccccgtaggaaccgaacggtccgtaggaggtggaagtacgggaactatactacgacgtcccgtgtaccccgtaggtcggtcgacctaaagtttaaacggtttcgaccgtaaacgtaaacgttaaaccgtttacggaaacggtacggtacgggttacccaaaccgtagtaaccgaacccgtaaccggacaacccgttaccaacgttaacccaaaccacgaaccgtaccctaaacgtaacggtaacggaaaccgttaggaacgggaacgtaaacccgtaagaaccgtacgtacggaaccgtaaccgtaccggttaccgttttaagttacgttagtacgtaactaaaagtaaacgtaagttacgaaacgtaaacggtaagtcgtttacgtttagaagttacggtacgggtacggtaaaccgg

SEQ ID NO: 397961 - DNA, 581 bp, Homo sapiens
  misc_feature: GZ8MTXP02GZ6K6.13.33.C11.1.454.CMB.2.raw
  modified_base (211)..(211): a, c, t, g, unknown or other
  modified_base (351)..(351): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctnagttgtaatgtgtctggtggctccctaagtaggactacttactactggggctggatccggcacgcccccgagggaagggctggagtggagttggggatatctcttagtagtgggagtacgaactacaactccgtccctanaagacgtcgagtcatcatatccgtagacaggtaccaggaactattcctaccctagaaacgtgagttctgtagaccgtcgacagacacggctgtctattatgtgacgagacggacaaagtgtggttacgaaggggtacgttacgacgttacggtcgggggaccaacgggggtaaccctcggtacccaccggttctccctacgacgaccctccgaaccgtaacggggccccc

SEQ ID NO: 397962 - DNA, 668 bp, Homo sapiens
  misc_feature: GZ8MTXP02FXS2X.13.33.C11.1.454.CMB.2.raw
  modified_base (328)..(328): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagccgtggggcctcagtgaggtctctgcaagacctctggactacaccgtcaccgacgaccatatatacgtgggtgcgacacggcccctggacaaggctgagtggagtgggacatancgacgtcctgtccgagtggtcgaccaacgtaaaagtttcgcaacgtaacgtaaactttacgaacgggaacgacgggggtaccaaccgtaagtacgaacccgaaccggaaccgaccgttacccaactaaccaaaccacaacgaccttaaacacgtaacgggaaacgtaggaacgggaacgtaccgtaaaacgtactacgtacggaaaccgaccgtaaccggggttaccgttttaagtttacgttaggtacgtaacgtaaaacgttaaagtaaagtttacgaacgaaaacgtaagttaggttacttttaaggagttaaggttcgggttacggggtaaaccgg

SEQ ID NO: 397963 - DNA, 582 bp, Homo sapiens
  misc_feature: GZ8MTXP02GQHL3.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcgagtgaaggtctctgcaagacctctggatacaccgtcaccgacgaccatatatactgggtgcgacaggcccctggacaaggccttgagtggagtgggacatatcacgcctgtccagtggtgaccacaaagtttgcacagtactttacgagacgagggtcacatcgaccacggacacgtcactacgaacacacgacctacagtaggaacgtagaggacgaccgtaaagactacgtacggaaccgaccgaccgggtaccgtttaattaacgttacggtacgacgtaaaataaacggtaatttacgaactaaaacgtaagtacggttacttttagagttagtacgggtacggggtaaccgg

SEQ ID NO: 397964 - DNA, 615 bp, Homo sapiens
  misc_feature: GZ8MTXP02JD1IT.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtagactactactacgtgggctggatccggcacgcccccgagggaacgggctgggagtggagttggggatagtctcttagtaggtgggagtacgaactacactccgtcctacaagacgtacgagtcatcatatccgtagacaggtccaaggtaactaacttcctacctagaaagtgtacgttctgtcgaccgtcgcaagacacgctgtactattatgtagacgtaggacggactaaagtagtaggttacggaagggtacgtttcggaacgttacgggcgggggtacccaaacggggtaaccccgtcggggtccctaacccgggttcctcccgtacgacccgtaccccgtcccgtaaacccggaacgggtacccccg

SEQ ID NO: 397965 - DNA, 574 bp, Homo sapiens
  misc_feature: GZ8MTXP02IWA71.13.33.C11.1.454.CMB.2.raw
  modified_base (409)..(409): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacacggcccctggacaaggccttgagtggatgggacatatcagccctgtcagtgtcgcactaagttgcacagactttcgaaggacagggtcacatcgaccacggacacgtcatcaaacacagcctanataggaaactagaggacgacctaaagactacgtagaccgacgtacgggtaccgtttaattacgttgtagtaactaaaagttaaagtaaatttacggaaactaaaacggtattaggtacttttaaggaattagttagggtacggggtaccgaaaggggtactaacg

SEQ ID NO: 397966 - DNA, 688 bp, Homo sapiens
  misc_feature: GZ8MTXP02IGTZH.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagagtggggcctgtcccagctgcagctgcaggagtcgggccaggagtggtgaagccttcggagaccctgtccctctagttgtaatgtgtctggtgctacctaagtaggactacttactacgtgggctggactccggcacgcccccgagggaagggcgtggagtggagttggggatatcgtcgttagtaggtgggagtaacgtaaactacaaactcccgtacctacgaagacgtacgagtcatacattactccgtagacgtacgtaccaaggaacgtaacttcctacccgtagaaagttgtaacgtttcgtgtacgacccgttacgacgaacgacgtaaccgggtcttggttacctttaagtttacgtggttacggccggtaaagtaccgggaaataaagttaggttggttaccgaaagggtacgtttacggaaccgtttacgggaccgggggaacccgtaacgggggtaccccgtacgggttacccgaaccccggttcttccccgtacgacccggtacccctaccccgaaaaccggtaacccgggtcccccg

SEQ ID NO: 397967 - DNA, 574 bp, Homo sapiens
  misc_feature: GZ8MTXP02JSK9X.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagccgtggggcctcagtgaaggtctcctgcaagacctctggatacaccgtcaccgacgaccatatatacgtgggtgcgacgacggcccctggacaaggccttgagtggatgggacatatcagccctgtcagtgcgaccataagttcacacagtactttcaggacacgggtcacgatacgacccgacggacacgtacaataccaaacacacgacctacagtaggaactggaacgacgacctaaaggacttacgacgacgaacgtacggtaccgtttattacgttgtagtactaaaagtaagtaagttagaacgtaaacgacttagtacgtttaagacgttagtacgggtaggaccgaagggactaacgg

SEQ ID NO: 397968 - DNA, 807 bp, Homo sapiens
  misc_feature: GZ8MTXP02HUXPM.13.33.C11.1.454.CMB.2.raw
  modified_base (247)..(247): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagccgtgggcctcagtgaggtctcctgcaagacctntgatacaccgtcaccgacgaccatatatactgggtagagacgacggcccctaggacaaggcctagagtggagtgggactagtactcgacgtcctgtacccgaggtggtacacccgtaacgttaaaaggtttcgacccgtaaacgtaaacggttaaaccctttttaccgaaacgggggtaaccgtaaacgggggttacccaaaccccgtaaacggttacccgggaaaaccccgtaaaccccgggggaaacccgtaacccggggtttaaacccccaaaccgtttaaaccccgaaaaacccgaaccctaaaccggtaacccccttaaaacgtaaaccggttaacggggtaaaaccgttagggaaacggggtaaacggtaaccccgtaaaaggtaacgttaccgttaacgggaaacccgtaaccggtaacccgggtttaaccgtttttaaacgtttaacgtttaggttaacggtaaacctaaaagttaaaagtaacgttacgtaacgaaaacgtaagttacgttacgtttttacgaagtttacggtagggtacgggtaaaccgg

SEQ ID NO: 397969 - DNA, 594 bp, Homo sapiens
  misc_feature: GZ8MTXP02JRDO6.13.33.C11.1.454.CMB.2.raw
  modified_base (197)..(197): a, c, t, g, unknown or other
  modified_base (375)..(375): a, c, t, g, unknown or other
  modified_base (401)..(401): a, c, t, g, unknown or other
  modified_base (450)..(450): a, c, t, g, unknown or other
  modified_base (480)..(480): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtcggccccgganagacggccacaattccctgtgaaggaaacaaccttagaagtcagaatgtccatggtaccagcagagtcaggccacggcccctggtggtcggtcattctagtagggataacgtacccggcctcgtgggactccccgtgaccgtattcctcgtcggctaccccgaacgtcggggaaaccnccggccacccctgaccatacaaacgngacgacccgaaaggacggggtatggacggctagacttattagtgtacgnggtgtagggactacgcctaaccgacgggtntagtagttccgggacggcggaacccgagccgtacgacccgtcgtacggcgacgcccgaaggccctcgccccgtcgtcaccgtcctccgtaccctcccctctccgtacgtcgtcg

SEQ ID NO: 397970 - DNA, 673 bp, Homo sapiens
  misc_feature: GZ8MTXP02G4D8C.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggccaggagtggtgaagccttcggagaccctgtccctcagttgtaatgtgtctggtggctcctaagtacggactacttactacgtgggctggatccggcacggcccccgaggggacgggcgtggagtggagtgggatatctcttagaggtggagtacgaatacaactcctcctacagacgtcgagtcatcatactccgtagacgaacggtaccaagggtaacgtaacttacctaccctagtaaaacgtgtaacgtttcgtggtacgaccggttcgacgacgaccgaccggtactgtttaccttagtttacgttggttgacgaaggaaccggtataaaagttacggttcggttacgtaaggggtacgtttaccggaacggttaccggtacgggggaccggtaaaccggggttaccccgtacggggttaccccgtaccggttcccttacccgttaccgaccggtaccccgttaccccgaaacccggaaccgggttacccccgg

SEQ ID NO: 397971 - DNA, 665 bp, Homo sapiens
  misc_feature: GZ8MTXP02FYIBW.13.33.C11.1.454.CMB.2.raw
  modified_base (247)..(247): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagagccgtgggcctgagtgaaggtctcctgcaagcctntggactacaccgtcaccgacgaccatatatacgtgggcgcgacacggcccctggaacaacggtccttaggagtggagtgggactatactcacgccctgtcccgaggtcggtcacctaagtaaagtttcgaccgactaaaggttaacctttacgaacgggtacgtacggggtacccaaccgtacgtaccgaacccgaacggaccctaccgtaccaacgtaccaaaccacaacgtccctaaacacgtacggaaaccgttaggaacgggaaccgtaaccgtaaaggtacctacgtacggaaccggtaacgtaccggtttaccgttttaagttacgttacgtacgactaaaagttaaacgtaagttacggaactaaaacgtgttacgttacgtttagattaacggtgggtacggggaaaccg

SEQ ID NO: 397972 - DNA, 634 bp, Homo sapiens
  misc_feature: GZ8MTXP02F2X0H.13.33.C11.1.454.CMB.2.raw
  modified_base (211)..(211): a, c, t, g, unknown or other
  modified_base (350)..(350): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctnagttgtaatgtgtctggtgctcctaagtaggactacttactacgtgggctggatccggcacgcccccgaggggaagggctgggagtggagttggggatatctcttagtaggtggagtacgaactacaatccgtacctanaagacgtcgagtcatcatatccgtagacaggtccaaggaactattcctacccgtagaaagtgtaagttctgtcgaccgttcgacgagacacggtctgtcttatttagttgtacgtagaacgacggtactaaaagttacgttagggttacgaaggggtacgtttacggaaccgttaacggttcgggggaacccgtaacggggtaaaccccgtttggggtaccctaacccgggtccttaccccgtacgaacccggcccttaccccgaaccgaaacggggtcccccg

SEQ ID NO: 397973 - DNA, 599 bp, Homo sapiens
  misc_feature: GZ8MTXP02H07E7.13.33.C11.1.454.CMB.2.raw
  modified_base (198)..(198): a, c, t, g, unknown or other
  modified_base (355)..(355): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtcgggccccgganagacggccacaattccctgtggaaggaaacaacttagaagtcaagaatgtccatggtaccagcagaagtcgacggccacggcccctggtggtcggtcattctaagtaaggggaactaaacgaacccggcctacgtcgggacttcccgtgaaccgttntcgtcgtcgcctacccgaacgaccggaacaccgccaccgacaccacacaacgacgacgaccgaaggacggtagagacgactagtacttagttagtgtacgtaggtggtaggacgacgtacgacgtaggtagagtacggtcggacggacggacacgcgacgaccgtacgacgacgacgaccgacgccgccgcccgtcgtaccaccgtccgtacccgtacccctacctcctacgtacgtacgtacg

SEQ ID NO: 397974 - DNA, 632 bp, Homo sapiens
  misc_feature: GZ8MTXP02IOB2W.13.33.C11.1.454.CMB.2.raw
  modified_base (368)..(368): a, c, t, g, unknown or other
tcagtcacgtactacacgaccggtgctcgatttagagtgagctcgttgggtttgggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggacgaccctgtccctcagttgtaatgtgtctggtgctccctaagtgactacttactacgtgggctggatccggcacgccccgagggaagggctggagtggagttggggatatctcttataggtggagtacgactacactcccgtcctacgagacgtcgagtcatcatatcgtanactacggtaccaggaacgtaattcctaccctagaaacgttgaagtttcttaggtacgacccggttcgacaacgaccgacgggtacttggttacttatttaagtttgtaggacgtaaggaccggtactaaaagttagtggttacgaggggtacgttaccggacgttacggtcgggggtacccaacggggtaaccccgttggtacccgtacccggttcctcccgttacgaccggtcccctacccgaaccggaaaccgggtcccccg

SEQ ID NO: 397975 - DNA, 874 bp, Homo sapiens
  misc_feature: GZ8MTXP02G3ALL.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagcctggggcctcagtgaaggtctcctgcaagcctctggatacaccgtcaccgacgaccatatatacgtgggtgcgacgacggcccctaggacgaacggtccttaggacgtggagtgggaacatactcgacgccccgtgtcccgtaggtcggtacgacccgtaacgtaaaaggtttcgaccgtaaacgtaacggttaaacccgttttaccgaaacggggtaaccggtaacgggggttacccaaaacccgtaacgttaacccgggaaacccccgtaaacccgggggaaacccgtaaaccccgggtttaaccccgaaacttaaccccaaaaacccgtaacccgaaacccggttaacccccttaaaaccgtaacggttaaaccggggtaaaaccggtttacggggaaacggggtaaccggtaaaccccgttaaaaggtacgttacccggttaacggtaaaccccgggtaaaccggttaacccggggtttacccgttttttaaaacgtttaaacggttttacggttaaacgggtaaaccctaaaaaggtttaaaaacggtaaaacgtttaacggaaaacccgtaaaaaggttaacgtttaccggttaacgtttttacggtaaaacgtttaaggtttacgggggttaacgggggtaaaaccccggg

SEQ ID NO: 397976 - DNA, 596 bp, Homo sapiens
  misc_feature: GZ8MTXP02I1YUF.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactacgtgggctggatccggcacgcccccgagggaaggggctggagtggagtttggggatatctcttagtaggtgggagtaacgaactacaactccgtacctacaagacgtacgagtcatcatatccgtagacaggtaccaggaacattcctacctagaaagtgagttctgtgaccgtgcagacgcgctgtacttattattggtgacgagacgacaaagtagtggttacgaggggtattacggacgttacggtacgggggaccaacgggggtaacccctcggggtaccctaccggttccgtcccgttcgaacgtccccgtacccgaaccgtaaaccggggtcccc

SEQ ID NO: 397977 - DNA, 524 bp, Homo sapiens
  misc_feature: GZ8MTXP02FQDQP.13.33.C11.1.454.CMB.2.raw
  modified_base (354)..(354): a, c, t, g, unknown or other
  modified_base (408)..(408): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactggtgcgacaggcccctggacaaggccttgagtggatgggacatatcagccctgtccagtgtgccacaaagtttncacagaacttcagacagggtcacatgacacggacacgtcatcaacacagcctanactggaactgaggagacctaaagatcacgacgaacacggtccgtttaattaacttgtgtacaaataaagtaaacttgactaaaacgaatagacttttagatagtgtacggggaacg

SEQ ID NO: 397978 - DNA, 705 bp, Homo sapiens
  misc_feature: GZ8MTXP02IV7TQ.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagagccgtgggcctgagtgaaggtctcctgcaacgacctgtggactaccaccgtcaccgacgaccatatatacgtgggtgccgacgaccggccccgtaggaaccgaaggtccgttaggacggtggagtagggaacaatactccgacgccccttgtaccgtaggtggtccgaccctaagtaaagtttcgacaacgtaacgtacctttcggaacggtaaccgtacgggtaccaccgtaagtaccgaacccgacggaaccctaccgtaccaactaccaaaccacgaacgtaccctaacgacgtaacggaaacgtaggaacggaacgtaccgtaaagtacgtaccgtacggaaccgaaccgtaccgggttaccgttttaagttacgttaggtagtaacgtaaaattaaaggtaaacttacggaaacgtaaaacgtacgttacggttactttaaggtaagttaggttacggggtacggggtaaccgtaaacggggtactaacgg

SEQ ID NO: 397979 - DNA, 635 bp, Homo sapiens
  misc_feature: GZ8MTXP02I4F91.13.33.C11.1.454.CMB.2.raw
  modified_base (245)..(245): a, c, t, g, unknown or other
  modified_base (277)..(277): a, c, t, g, unknown or other
  modified_base (370)..(370): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctgagtgaaggtctctgcaagacctntggatacaccgtcaccgacgacatatatacgnggtgcgacgacggccccgtaggacaaggtccttggagtggagtgggacatatcacgtccctagtcaggtcggcgaccaagtaaagttcgacanacgtacttcgaacggtacgacgggtaccaaccgagtacgaccgacgaacgaccgtaccactacaaacaccaacgacctaacagtacggtaaacgtacggaacggacgaaccgtaagacgttacgacggaaccgtaccgtaccgggttacctttaagttagttagtacgaactaaaagtaaagtaacttaacgaaactaaacggtaattcgttaagtttaagtaagttaggttacggtaccggggtaacgaacggggaactaacgg

SEQ ID NO: 397980 - DNA, 583 bp, Homo sapiens
  misc_feature: GZ8MTXP02JXKI6.13.33.C11.1.454.CMB.2.raw
  modified_base (455)..(455): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactacgtgggctggatccggcacgcccccgaggggaagggctggagtggagttggggatatctcttataggtgggagtacgaactacaactccgtcctcaagacgtcgagtcatcatatccgtagacacgtccaaggaacgaattctaccctagaaagtgtagttctgtcgaccgtcgacagacacggtctgtctattatgtgngagacggactaaagtgtggttcgagggtacgttcgactacggtcggggacccgtacgggtaacccgtggtacccgtaccggttcctcccgtaccgacggtccctacccgaaccgtaacgggtcccccg

SEQ ID NO: 397981 - DNA, 597 bp, Homo sapiens
  misc_feature: GZ8MTXP02F3C78.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatacgtgggtgcgacaggcccctggacaaggccttggagtggatgggacatatcagtccctgtcccagtcggtcgaccacgtaaaaggtttgctaacgaaggtaaacctttcgaacgggaacgacggggttaccaaccctagtacggaacccgaacgggaccaacgtacccaataccaaacacacgcctaacgatggaaactggaacggacgacctaagactcgacgacgacgacggtacgtttattacgttagtagactaaagtaaagtaattacgaccaaaagtaatcgttactttaggattacgtaggacgggtaaccg

SEQ ID NO: 397982 - DNA, 764 bp, Homo sapiens
  misc_feature: GZ8MTXP02JFSZX.13.33.C11.1.454.CMB.2.raw
  modified_base (245)..(245): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagccgtggggcctcgagtgaaggtctcctgcaagacctntggatacaccgtcaccgacgaccatatatactgggtgcgacgacggcccctggacaggccttgagtggatgggacatatcgagcccctgtcaggtcggtcgcctaacgtaaagtttcgacgaacaaggtaacccttttcgaaacgggtaaccgtaacgggggttacccaaacccgtaagtaccggaaaccccgaaccggggaaaccctaacccgggttacccccaaacttaaacccgaaaacccaaccaaacggtaacccccttaaacaacggtaacgggtaaaacccgttgggaaacggggaaaccgtaaccccgtaaaagggtaccttaaccgtacgggaaaccgtaacccggtaaaccggggtttacccgtttttaaagtttaaccgtttaggttaacggtaaccgttaaaaggttaaagttaaaacgttacgaaacccggtaaaacgtaagttacgttacgttttaagaaacgtttagtacggggttacggggaccgtaaacggggacttaaccg

SEQ ID NO: 397983 - DNA, 561 bp, Homo sapiens
  misc_feature: GZ8MTXP02F0OFK.13.33.C11.1.454.CMB.2.raw
  modified_base (432)..(432): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggccaggagtggtgaagccttcggagaccctgtccctcagttgtaatgtgtctggtggctccctaagtaggactacttactactggggctggactccggcacggcccccgaggggaacgggctggagtggattggggatatctcgttataggtgggagtacgaactacaaactccgtcctcaagacgtcgagtcatcatatccgtagacagtcgagaacgattctacctagaaagtgagttctgtcgaccgtcgcagacncggactgtctattagttgtgcgaagacggacaaagtagtgttacgaggggagttacgacgtacggtcggggacgacgggtaaccctcggactaacccgtcgtcctcacgccctacaccgaacggccccg

SEQ ID NO: 397984 - DNA, 585 bp, Homo sapiens
  misc_feature: GZ8MTXP02IQCRO.13.33.C11.1.454.CMB.2.raw
  modified_base (334)..(334): a, c, t, g, unknown or other
  modified_base (347)..(347): a, c, t, g, unknown or other
  modified_base (373)..(373): a, c, t, g, unknown or other
  modified_base (404)..(404): a, c, t, g, unknown or other
  modified_base (420)..(420): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactgggctggatccggcagcccccagggaaggggctggagtggagttggggatatctcttatagtgggagtacgaactanaactccgtcctanaagacgtcgagtcatcatatccgtanacagtcaagaacgattcacctgaaatgattntgtgaccgtgcagacncgattgtctattattgtgcgagacggactaaagttagtggttacgaagggtacggtttaccgacgttacgtagggggacccaacgggggtaacccccgttcgggtacctacccggttcctcccgtcggaaccgtcccgttacccaacccggaacggtaacccccg

SEQ ID NO: 397985 - DNA, 577 bp, Homo sapiens
  misc_feature: GZ8MTXP02FYODD.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtagactacttactacgtgggctggatccggcacgcccccgagggaaggggctgggagtggagttggggatatctcttatagtgggagtacgaactacaactccgtcctacaagacgtcgagtcatcatatccgtagacaggtaccaggaaacgaattcctaccctagaaaagtgaagttctgtcgaccgtgacagacacggactgtacttattagttgtagcgaagacggacaaattagtggtacagggtattacgacttacggtcggggaccaacggggacccctagggtccaaccgtcgtcctacgaacgccccgtaccaacccgtaacggacccc

SEQ ID NO: 397986 - DNA, 613 bp, Homo sapiens
  misc_feature: GZ8MTXP02HKVOP.13.33.C11.1.454.CMB.2.raw
  modified_base (242)..(242): a, c, t, g, unknown or other
  modified_base (429)..(429): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagagcctggggcctcagtgaaggtctcctgcaagacctntggatacaccgtcaccgacgaccatatatacgtgggtgcgacacggcccctaggaacaaggccttggagtggagtgggaacatatcagccctgcaggtggtcgccaactaaagtttgacacgaagtactttcgaaggacagggtccacatacgaccacggacacgtacacacaacacacgccctaanacgtaggaaacttagggaacgtacccgttaaagacttacgacgaaccgaccgtaccggggttaccgttttattaacgttgtacgtaactaaagtaaaaggtaattagaaaccgtaaaacgtgtacgttagttttaggaagttacgtagggtacgggggaaccgaagggtaccgttaacgtacgg

SEQ ID NO: 397987 - DNA, 563 bp, Homo sapiens
  misc_feature: GZ8MTXP02JA4BA.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctctgcaagacctctggatacaccgtcaccgacgaccatatatactgggtgcgacaggcccctggacaaggccttggagtggatgggacatatcagccctgtcagtggtcgccacaaagtttgcacagactttcaggacagggtcacatcgaccacgacacgtccatacaaacacacgcctacataggaaactggaacggaagccttaaagactcgtagacgacgacggtccgtttaattacttgtacgactaaaagtaacgtaaatttacggacaaaacggtactagttactttaagaattacgtggtacgggaccgtaaaggggactaaacgg

SEQ ID NO: 397988 - DNA, 534 bp, Homo sapiens
  misc_feature: GZ8MTXP02F220M.13.33.C11.1.454.CMB.2.raw
  modified_base (373)..(373): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactggtgcgacaggcccctggacaaggccttgagtggatgggacagtatcagccctgtccagtggtgccacaaagtttgcacagaactttcagganagggtcaccatgacacgacacgtcatcaacacacgcctaacataggaactgagagacctaaagactctgaacgactacggtccgtttaattattagtgacaaataaagaattacgactaaaacgaatagtacttttagattacgtaggttacggggaaccg

SEQ ID NO: 397989 - DNA, 543 bp, Homo sapiens
  misc_feature: GZ8MTXP02IB54K.13.33.C11.1.454.CMB.2.raw
  modified_base (461)..(461): a, c, t, g, unknown or other
  modified_base (491)..(491): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcgagtgaaggtctcctgcaagacctctggatacaccgtcaccgacgaccatatatacgtggtcgcgacacggcccctgggaaccaaggccttaggaggtggagtgggacatatcacgcctgtccagtggtcaccaagtaagttcgcacgagtaaacttgaggacgagggtacaccgatacgaccgacgacacgtacatacaacacacgcctacactaggaactggagcgactaagntcgacgacgacgacggtacttattactganactaaagtacgtatcgaacaacgaagtcttagttagatagtggtacggaacg

SEQ ID NO: 397990 - DNA, 538 bp, Homo sapiens
  misc_feature: GZ8MTXP02HL18W.13.33.C11.1.454.CMB.2.raw
  modified_base (407)..(407): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatgggacatatcagccctgtcccagtggtgccacaaagtttgcacagtaactttcgaggtacagggtcacatacgaccacggacacgtccancaacacacgcctacataggaactagaggacgacctaaagactactagaacgaccgacggtaccgtttaattaacttgtagactaaataagaattagacaaagaatagtacttttagatagtggtagggacg

SEQ ID NO: 397991 - DNA, 734 bp, Homo sapiens
  misc_feature: GZ8MTXP02G4XON.13.33.C11.1.454.CMB.2.raw
  modified_base (681)..(681): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtggggcctcgagtgaaggtctcctgacaagacctgtggatacaccgtcaccgacgaccatatatacgtgggtgacgacgacggcccctaggaacgacggtccttaggaggtagggagtacggggaactagtactcgaccgtcccgttagtacccgtaggtcggtcgacccgtaagttaaaacggtttcgaccgtaaacgtaagttaaacccgtttacgaacgggtaaccggtaacggggtacccaaacccgtaagtaccggaaacccgaaccgggtaaccctaaccggtaccctaacaccaaaccgaccaccgtacctaaacacggtaacggaactagggaacggtaacgaacccgtaaagacgttacgaacggaccgtaaccggtaaccggttaccgtttaagtttaacgtaggttacgaaacgtaaaagtaaaagtaacgttaacgaaacgttaaaacggtntttaaccggttacttttaacggaagttacgttacgggggttaacggaaaccgg

SEQ ID NO: 397992 - DNA, 739 bp, Homo sapiens
  misc_feature: GZ8MTXP02H574D.13.33.C11.1.454.CMB.2.raw
  modified_base (225)..(225): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtgggctgaggtgaagagccgtggggcctnagtgaaggtctcctgacaagacctgtggactacaccgtcaccgacgaccatatatacgtgggtgcgacgacggcccctaggaccaggccttaggaggtggagtgggaactatataccgacgtcccgtgtcccgaggtcgggtcgaccgtaacgtaaaggtttcgacctaaacgtaaacgttaaaccgttttacgaaacggggtaaccggtaacgggttacccaaacccgttaacgtacccggaaaccccgaaccgggtaacccgaacccggttacccaaaccgtaacccaaaacccacccgtaaccgaacccctaaaccgtaacggttaacgggaaacgttacggaacgggaacgtacccgtaaaggtacttaccgtaacggaacgtaaccggtaccggttacgttttaactttacgttagttacgaaactaaagttaaacgtaacgttacgaacgtaaaacggtaattacgttacgtttacgaagtttacggtacgggttacggggaaaccgg

SEQ ID NO: 397993 - DNA, 623 bp, Homo sapiens
  misc_feature: GZ8MTXP02IX9VM.13.33.C11.1.454.CMB.2.raw
  modified_base (353)..(353): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtgctccctaagtaggactacttactactgggctggactccggcacgcccccgagggaagggctggagtggagtttggggatagtctcgttataggtgggagtacgaactacaactccgtccctanaagagtcgagtcatcatactccgtagacacggtccaaggaacattctacccgtagaaagtgaagttctgtcgaccgtcgacaagtacacggcttcgtacttagtttatgtgacggagacggactaaagtgttggttacgaggggtacgtttacggacgttaacggtcgggggaccctaacgggggtaaccccgtcggttacccgaacccgttccgttccccgtaccgtaaccggcccccttacccaaacccgggaaccggggtacccccg

SEQ ID NO: 397994 - DNA, 632 bp, Homo sapiens
  misc_feature: GZ8MTXP02GUJNA.13.33.C11.1.454.CMB.2.raw
  modified_base (250)..(250): a, c, t, g, unknown or other
  modified_base (287)..(287): a, c, t, g, unknown or other
  modified_base (465)..(465): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagccgtggggcctcgagtgaaggtctcctgcaagacctntggatacaccgtcaccgacgaccatatatacgtggtncgacacggcccctggacaaggcttgagtggatgggacatatcacgaccctgtcccgtaggtggtcgacccaacgtaaaacgtttgcctaacgtaacgtaaacctttacgaacgggtacgacgggtaccaaaccagacgaacccgacggacaccgtaccactacaaacacacgacctanacgtaggaactggacggacgaccgtaaagacgttacgacgaacgtaccgtaccggtaccgtttaagttagtttacggtagtaactaaagtaaagtaacgttacgaaccgtaaacgaagttagttacgttttacggactttaaggttacggttacggggtaaaccggg

SEQ ID NO: 397995 - DNA, 573 bp, Homo sapiens
  misc_feature: GZ8MTXP02JQ475.13.33.C11.1.454.CMB.2.raw
  modified_base (224)..(224): a, c, t, g, unknown or other
  modified_base (248)..(248): a, c, t, g, unknown or other
  modified_base (349)..(349): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagagccgtggggcctnagtgaaggtctcctgcaagacctntggatacaccgtcaccgacgaccatatatacgtggtgcgacacggcccctggacaaggccttgaggtggagtgggacatatcagccctgtccgagtggtcncctaactaaagtttcgctacgaagtaactttacgaggtacgagggtaccaaccagtacgaccgacggacaccgtacactacaacacacgacctacagtaggaactaggaggacgaacctaagactacgtagacgaacgtacgggtacctttatttagtactaggactaaagtaaagtatacgacgaaaacgtgtacgttacttagagttagtacggtaggaacg

SEQ ID NO: 397996 - DNA, 533 bp, Homo sapiens
  misc_feature: GZ8MTXP02FT5K5.13.33.C11.1.454.CMB.2.raw
  modified_base (281)..(281): a, c, t, g, unknown or other
  modified_base (323)..(323): a, c, t, g, unknown or other
  modified_base (501)..(501): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatacgtgggtncgacacggcccctggacaaggccttgagtggatgggacatancagccctgtcaggtggtcgaccacaaagtttgacacagtacttcgaggacgacgggtcacatcgaccacggacacgtcatacaacacacgacctacagtacgaaactggaggagacctaagatctagacgacacggtcgtttattatgtgacaataagtaattcgacaacgtatagtntttaagatagtggtacgggacaagggactacg

SEQ ID NO: 397997 - DNA, 729 bp, Homo sapiens
  misc_feature: GZ8MTXP02I2VHF.13.33.C11.1.454.CMB.2.raw
  modified_base (288)..(288): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcagtgaaggtctcctgcaagacctcgtggatacaccgtcaccgacgaccatatatactgggtncgacacggcccctggacaaggcctagagtaggagtgggacatatcgacgccctgtcccaggtcggtacgacctaacgtaaagtttcgacctaacgtaaacggtaaaccgtttttaccgaaacggggtacgtaacgggggttacccaaacccgtagtaccggaaaccccgaaccgggaaacccgtaacccggttacccaaccgttaaccaaaccgaacccgaaacgtacccttaaacaaacgtacgggtaaaacgtgggaaacgggacgaaccgtaaacgtacgtaccgtacggaaaccgaaccgtaaccgggtttacccgtttaaagtttagtttacggtacggtaaacctaaaagttaaagtaacgtttaacgaaacgtaaaaccggtaagttcgttacgttttaggaatttaggttacggggtacggggtaaacccggg

SEQ ID NO: 397998 - DNA, 632 bp, Homo sapiens
  misc_feature: GZ8MTXP02H8OUD.13.33.C11.1.454.CMB.2.raw
  modified_base (306)..(306): a, c, t, g, unknown or other
  modified_base (310)..(310): a, c, t, g, unknown or other
tcagtcacgtactacacgaccggtgctcgatttagagtgagctcgttgggtttgggatgctttctgagagtcatggatctcatgtgcaagaaaatgaagcacctgtggttcttcctcctgctggtgcgctcccagatgggcctgtcccagctgcagctgcgaggagtcggccaggagtgtgaagccttcggacgaccctgtccctcgagttgtaattgtgtcgtggtgcttacctaagtacggtacttacttactacgtgggctggagtccggcacgccccgaggaggctggagtggagtgggatntctntagtggtggagtacaatacaatcccgtacctgaagcgtcgagtcagttcatacgtcgtaagacaggtaccaagaacgtatttcccacccgttagaaacgttcgtaacgtttctaggttacgaacccgtcgaaccgacgtaccgacgtacgttcgttaccgttaagtttaagttgtacgggaccgtaagaaccggtactaaaagttgtacggttacgaggggtaacttaccgaacgttcggacgggtaccgaaacgggtaccccgtggtaccctacggtcccgttaccgaccgacgtacccctacccgaaccggtaccgcccg

SEQ ID NO: 397999 - DNA, 611 bp, Homo sapiens
  misc_feature: GZ8MTXP02IDCOQ.13.33.C11.1.454.CMB.2.raw
  modified_base (212)..(212): a, c, t, g, unknown or other
  modified_base (385)..(385): a, c, t, g, unknown or other
  modified_base (451)..(451): a, c, t, g, unknown or other
  modified_base (489)..(489): a, c, t, g, unknown or other
tcagtcacgtactacacgaccggtgctcgatttagagtgagctcgttgggtttggggatgctttctgagagtcatggatctcatgtgcaagaaaaatgaagcacctgtggttcttcctcctgctggtggcggctcccagatggggcctgtcccagctgcagctgcaggagtcgggccaggagtggtgaagacttcggacgaccctgtccctnagttgtaatgtgtctggtgctcctaagtagactacttatacgtgggctggactccggcacggcccccgagggaacgggctgggagtggagttggggatagtctcttagtaggtgggagtaacgaactaacaatcccgtacctacaagacgtacgagtcatcgatactccgtanaacacggtaccaaggaacgtaattccaccctagaaagtgtattacgtgtgaccgtcgacaacgacncggactgttactagtttattcgtggacgagaaccgtanaaagtagttgtacgaagggtacttacgacgttcggacggaccggaacgggtaaccgtcggttaccgacccgtaaccgtcccgtacgcgtaccccgtacccgaaccggtaaccggtacccccg

SEQ ID NO: 398000 - DNA, 701 bp, Homo sapiens
  misc_feature: GZ8MTXP02FWXDZ.13.33.C11.1.454.CMB.2.raw
  modified_base (198)..(198): a, c, t, g, unknown or other
tcagtcacgtactacacgaccggtgctcgatttagagtgagctcgttgggtttgtggctgggcctcaggaagcagcatcgggggtgccgcagccatggcctggaccgctctcctgctgagcctccttgctcactttacagcttctgtggcctcctatgagttgactcagccactctcagtgtcagtcggccccggganaggacggccacaacttccctgtagaagggaaacaaccttagaagtcagaatgtccactggtaccagcagaagtcaggccaggccccctgtggtggtcatctagtagggataataaccggccctcgtgggactccctggaccctattctctcggccctacccaacgtccggggaaaccaccgggcccacccctgacccatacaaaccgagacgacccaaaggaccggggatggaggactggaacttattaattgtacgtagggtgtacggggacacgacgaacccgtacggggtagtaacgttaagttcccggggcggggaccgggggaaccaacggccgtacgggacccccgttaccgtaacggggttcccaaaccgggaccccgtaaaacggggtccctccccgggtacccccccgttcggggtcccctaaacccgttcccgttcccggtttcccccccggtccccctttcccgttacccggttacggtttaaaccccgggg

SEQ ID NO: 398001 - DNA, 541 bp, Homo sapiens
  misc_feature: GZ8MTXP02I2KK6.13.33.C11.1.454.CMB.2.raw
  modified_base (278)..(278): a, c, t, g, unknown or other
  modified_base (342)..(342): a, c, t, g, unknown or other
  modified_base (363)..(363): a, c, t, g, unknown or other
  modified_base (406)..(406): a, c, t, g, unknown or other
  modified_base (416)..(416): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctgggcctcagtgaaggtctcctgcaagacctctggatacaccgtcaccgacgaccatatatactgggtncgacaggcccctggacaaggccttgagtggatgggacatatcacgccctgtcaggtggtgccanaaagtttgacacagtactttnaggacaggggtcaaccatcgaccacggacacgtcatacaaacncacgcctaanagtagaactggaagacgacctaagatctagacgacgtacggtacgtttattactgtagtacaataaagtaattagaactaaagtactgtactttaagatagtggtcggggacaacgggactaacg

SEQ ID NO: 398002 - DNA, 600 bp, Homo sapiens
  misc_feature: GZ8MTXP02IJ466.13.33.C11.1.454.CMB.2.raw
  modified_base (190)..(190): a, c, t, g, unknown or other
  modified_base (280)..(280): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcnggggctgaggtgaagaagcctggggcctcagtgaaggtctcctgcaagacctctggatacaccgtcaccgacgaccatatatactgggtncgacacggcccctggacaaggccttggagtggatgggacatatcagccctgtcagtgtgccataaagttgcaacagtactttcaggacgagggtacaccatacgaccgacgacacgtacatacaacacagacctaacagtagaactaggaaggacgacctaaagacttacagaaccgacgacggtaccgtttaagtttacttagtacggtacaaaattaaaggtaaactttagaaacgtaaaaccggtaactttacggtactttttaaggaattaacggttagggttaacgggggacccgtaaaagggggaactaaccgg

SEQ ID NO: 398003 - DNA, 565 bp, Homo sapiens
  misc_feature: GZ8MTXP02HLMFR.13.33.C11.1.454.CMB.2.raw
  modified_base (246)..(246): a, c, t, g, unknown or other
  modified_base (425)..(425): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagccgtggggcctcagtgaaggtctcctgacaagacctntggatacaccgtcaccgacgaccatatatactgggtgcgacacggcccctggacaaggccttgagtggatgggacatatcacgccctgtcaggtggtcgaccaacgtaaagtttgacaacagtacctttcgaggacagggtcacatcgaccacggacacgtcatcaaacacagcctaanataggaaactgaaggagacctaagactacagacgacgacggtacgtttatagttgtagtactaaagtaaagtaacttagaacctaaaacgtacttagtattttaagattaagtgggtacgggaccgaaagggacctaacg

SEQ ID NO: 398004 - DNA, 635 bp, Homo sapiens
  misc_feature: GZ8MTXP02INGL7.13.33.C11.1.454.CMB.2.raw
  modified_base (242)..(242): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagccccactcccaggtgcagctggtgcagtctggggctgaggtgaagagcctggggcctcagtgaaggtctctgcaagacctntggatacaccgtcaccgacgaccatatatactgggtgcgacaggcccctggacaaggccttgagtggatgggacagtatcagccctgtcagtgtgccataaagtttgacacagactttcgaggacgagggtccacatcgaccgacggaccacgtccatacaaacacagcctaacataggaaactggaacggacgacccgtaagactaccgtacgaacgaccgtaccgggttaccgttttatttacgttgttacgtaacgtaaaagttaaaagtaaacgtttacggaaaccgttaaaacggtaacgtttacgtttaaccgtttttaaggaacgtttaaggtttacgggggttaaccgggggtaacccggtaaaacgggggtaacttaaacccgg

SEQ ID NO: 398005 - DNA, 691 bp, Homo sapiens
  misc_feature: GZ8MTXP02G84TB.13.33.C11.1.454.CMB.2.raw
  modified_base (615)..(615): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagaagccgtggggcctcgaggtagaacggtctccgtgacaagacctgtaggtaataccaccgtccaaccgacgaacctataatacgtacgtgggtcgaccgacgacggcccctagggaacgaaggtccttggagtgggagtgggaactagtactcgacgtccgtagtcccgaggtggtacgacctaacggtaaagttcgaccgtaactaacggttaaaccgttacgaaacggggtaactacgggggtacccaaacgtacgtaaccggaacccgaaacgggaaccacccgtaccaacgtaaccaaacaaccgaacaccctaaacgacgttaacggaaccgtaggaacggtacggaactaaacggacttacgacgaacgacgtacggtacgtttattagtacgtanaactaaagtaacgtagttacgaactaacggtaattacgttacgtttaacgaaggttacggtacgggtacggtaacg

SEQ ID NO: 398006 - DNA, 637 bp, Homo sapiens
  misc_feature: GZ8MTXP02GQAOG.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcagtgaaggtctcctgacaagacctcgtggactacaccgtcaccgacgaccatatatacgtgggtcgcgacgcggcccctggacaaggtccttagagtggagtcgggacatactcgacgcccgtgtccgtaggtcggttacgaccctaagtaaacggttttcgaccgaaacgtaagtaaaccgtttcgaacgggtacgtacgggtaccaaccgtagtaccgaaccgacggacacgtacacgtacaacacacgacctagagtacggacgtagacggacgtacctaagactacgacggaaccgaccgtaccggtaccgtttaattacgtagtacgtaacgtaaagtaagtaacgtacgaacgtaaacgtaagttcgtacgttttagaagtttaggtacgggtacggggtaacg

SEQ ID NO: 398007 - DNA, 569 bp, Homo sapiens
  misc_feature: GZ8MTXP02IWVO5.13.33.C11.1.454.CMB.2.raw
  modified_base (295)..(295): a, c, t, g, unknown or other
  modified_base (356)..(356): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagacctgtccctcagttgtaatgtgtctggtcggctccctaagtaggactacttactacgtggggctggactccggcacgccccgagggaacgggcgnggagtggagttggggattatctacttagtaggtggtagtacgaactacaactccgtcctanaagcgtcgagtcatcatactcgtaagcagtaccaggaataactctacccgtagtaaacgtgtagttctggtagacccgtcgacagactcggacttgtccttagttactgtcgacgtacgacgactaaagtatggtacgaggtacgttcgacgtacggtcgggaccacggtaccgtgcctacgtctccactacgccctacgaccgaacggtccc

SEQ ID NO: 398008 - DNA, 627 bp, Homo sapiens
  misc_feature: GZ8MTXP02GVQ55.13.33.C11.1.454.CMB.2.raw
  modified_base (375)..(375): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtgggctggaggtgaagagccgtggggcctcagtgaaggtctctgcaagcctcgtggactacaccgtacaccgacgaccatatatacgtgggtgccgacgacggtccccctaggaacgaacggtccgttggaggtgggagtgggacatatcagtccctgcgaggtggtacacctaagtaacggttnacgtaacgaacgttactttcgaaacgggtacgtacggggtccaaccgagtaccgaaaccgacggaacctaccgtaccaataccaaacacacgacctaatagtacgtaactaggaaggacgtaaacgttaagacttacgaacgaccggtacgtaccggttacgtttattagtgtaacgtaataaaagtaagtaattacggaaactaacgtatggttacttaagatacggtcggaacgggtaccaaggactacg

SEQ ID NO: 398009 - DNA, 647 bp, Homo sapiens
  misc_feature: GZ8MTXP02IZEHN.13.33.C11.1.454.CMB.2.raw
  modified_base (348)..(348): a, c, t, g, unknown or other
  modified_base (372)..(372): a, c, t, g, unknown or other
tcagtcacgtactacacgaccggtgctcgatttagagtgagctcgttgggtttggggatgcttttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctcagttgtaatgtgtctggtgctccctaagtagactacttactactgggctggatccggcacgcccccgaggggaacgggctggaggtggagttggggattatctcttagtagtgggatacgaactacactccgtccanagacgtcgatcatcatactcgtanacagtaccaggaacattctaccgtagaaagtgagttctgtcgaccgtcgacagacgcggtactgttacttagtttattggtagaccgtagacggtactaaagttacgttagggtttaccgaaggggtacggtttaccggtacgttaaccggtcggggggtaacccgtaaaccggggtaaccccgttacggggttaccccgtaaccccggttcccttcccccgttacgaacccggtcccccgttaccccgaaacccggtaaccggggtaccccccg

SEQ ID NO: 398010 - DNA, 635 bp, Homo sapiens
  misc_feature: GZ8MTXP02JMI77.13.33.C11.1.454.CMB.2.raw
  modified_base (255)..(255): a, c, t, g, unknown or other
  modified_base (291)..(291): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagcgtggtgcaggtcgtgggggctggaggtgaagaagccgtggggcctcgagtgaaggtctcctgacaagcctntggatacacatccaccgacaccatatatacgtggtnacgacgacggcccctaggaaccaaggtccttaggacggtggagtcgggacatactccagccctagtcgagtggtcacaacgtaaagtttcgacaacgtagtaaccgttacgaggaaccgtacgggtacaaccgagtacgaaccgacggaaccacgtaccaataacgaaaccacacgacctaacgaataggtaaccgaggacggaacgacccgtaaagacgtactaggaaccgtaccgtacgttacgtttaacttaagttgtaacggtaactaaagttaaacgtaaagtttcgaaacgtaaaacgtagtagttacgtttagtaactttaggtacgggtaacgggg

SEQ ID NO: 398011 - DNA, 621 bp, Homo sapiens
  misc_feature: GZ8MTXP02HNH83.13.33.C11.1.454.CMB.2.raw
tcagtcacgtactacacgaccggtgctcgatttagagtgagctcgttgggtttgggatgctttctgagagtcatggatctcatgtgcaagaaaatgaagcacctgtggttcttcctcctgctggtggcggctcccagatgggcctgtcccagctgcagctgcaggagtcgggccaggagtggtgaagccttcggagaccctgtccctcagttgtaatgtgtctggtggctccctaagtaggactacttactactgggctgatccggcacgcccccagggaagggctggagtggattggggattatctactataggtaggagtacgaaactacaaatccgtccctacaaagacgtacgagtcatcaatatccgtagacagtaccaagaaacgtaaattcacccttagaaaagttcgaagttcctagtcgaccgtacgcgaagacacgggctggtcttaattattgtcgcgaagacgactaaagtagtggttacgaaggggtactttacggaacttacggtacggggacctaaacgggggtaacccttacggggtaccaacccgggttccttcccgaccgttaccggtaccctacccgtaacccgtaaaccggtaacccccgg

SEQ ID NO: 398012 - DNA, 607 bp, Homo sapiens
  misc_feature: GZ8MTXP02H2WIW.13.33.C11.1.454.CMB.2.raw
  modified_base (248)..(248): a, c, t, g, unknown or other
  modified_base (332)..(332): a, c, t, g, unknown or other
  modified_base (369)..(369): a, c, t, g, unknown or other
  modified_base (439)..(439): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagccgtggggcctcagtgaaggtctctgcaagcctntggatacaccgtcaccgacgaccatatatacgtgggtcgcgacacggcccctggacaacggtccttgagtggagtgggacatancacgccctgtcccgagtcggcgaccaactaaagtttncaacgaagtactttcgaggtacgagggtcaccatacgaccgacgacacgtcatacgaacacacgacctanagtggaactggaagacgtacctaagactacgtacggacgtacgaccggttaccgttttaagttacgttagtacgtaaactaaaagtaaaacggtaagttacggtaaactaaaacgttaagttacgttaacgttttacggtaattacggttgggtaacggggaaaccgg

SEQ ID NO: 398013 - DNA, 684 bp, Homo sapiens
  misc_feature: GZ8MTXP02JJX0R.13.33.C11.1.454.CMB.2.raw
  modified_base (197)..(197): a, c, t, g, unknown or other
  modified_base (253)..(253): a, c, t, g, unknown or other
  modified_base (645)..(645): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgnggggctgaggtagaagaacgccgtggggcctcgagtagaggtctctgacagacctntggactacacgtcaccgacgacctatatatacgtggtcgcgacgacggccccgtaggaacacggtcctagaggtaggagtagggactaagtacgtacacgtcccgtgtacccgtaggttcggactaccgtaacgtaaacggtttcgacctaacgtaaacgttaaccgtttaccgaaggggtaaccgtacggggtaccaaacccgtagtaaccggaacccgaaccgggaactaacccggtaccaacctaaccaaaaccgacgaaccgtacctaaacgacgtaacgggtaaccgtaggaacgggacaaccgttaaagacttacgtacggaacgaccgtaacgtcgtttaattacgttgtagtaaacaaagttaaacgtattacggactaaaagngttacgtagtttacgagttagtcgggttacggaaaccgg

SEQ ID NO: 398014 - DNA, 610 bp, Homo sapiens
  misc_feature: GZ8MTXP02HRDNU.13.33.C11.1.454.CMB.2.raw
  modified_base (223)..(223): a, c, t, g, unknown or other
  modified_base (233)..(233): a, c, t, g, unknown or other
  modified_base (245)..(245): a, c, t, g, unknown or other
  modified_base (323)..(323): a, c, t, g, unknown or other
  modified_base (334)..(334): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagagccgtgggcctnagtgaggtcncctgcaagcctntgatacaccgtcaccgacgaccatatactacgtgggtgcgacgaccggccccgtaggacgaacgccgttgagtggagngggactatacncacgcctgtcccgagtggtcgaccaacgtaaagtttgaccacgtaacgtaaccgtttacgaaggtactagggtacccgaaccagtacgaacccgaacggaccgaaccgtacccaacgaccaaacgaccgacgtaccctacgagttacgaacgtagaggacgaccgtaagatcgagacgacgacgtacgtttatagtacgtagaactaaagtaaacgtatacgtaaccgaaacgtaagttcgttacgtttacgatttaggtacggttacgggaacgg

SEQ ID NO: 398015 - DNA, 775 bp, Homo sapiens
  misc_feature: GZ8MTXP02HCOPP.13.33.C11.1.454.CMB.2.raw
  modified_base (221)..(221): a, c, t, g, unknown or other
  modified_base (245)..(245): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagctgggcctnagtgaaggtctcctgcaagacctntggatacaccgtcaccgacgaccatatatactgggtgcgacgaggcccctggacaaggccttaggagtggagtgggacatatcagccctagccagtcggtcgacctaacgtaaagtttcgaccaacgtaacgttaaaccgttttacgaacggggtaaccgtaacgggggttacccaaacccgtaagttacccggaaaccccgtaaccgggggaaaccctaaacccgggttacccgaaacgttaaccctaaaaccctaaaccgaaaccggtaccccctttaaaaccggaaaccggtttaaggggaaaacccgttagggaaacggggtaaacggaccccgttaaaaggtaacgttacgttacggaaacggaacccggtaaccggggttacccgtttttaacgttttaacgttagggtacggttaaacctaaaagttaaaacggtaaagtttacggaaacgttaaaaaccgtaagtttaccgggttactttttacggaacgtttacggttacggggttacgggggaaacccgg

SEQ ID NO: 398016 - DNA, 596 bp, Homo sapiens
  misc_feature: GZ8MTXP02GQE2R.13.33.C11.1.454.CMB.2.raw
  modified_base (196)..(196): a, c, t, g, unknown or other
  modified_base (213)..(213): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtcggcccgganagacgccacaacttccngtgaaggaaacactagaagtcagatgcatgtacagcagagtcagccacggccctgtggtgtcatctagtaggaataacgtaccggcctcgtgggactcccgtgaccgtattctcgtcggcctaccccgaaccggtcggggaaaccaccggacccacccgtacgaccactacaaacgacgaacgacccgaaaggacgggatgacggctagtactattagtgtacgaggtggacggacacgcaccgaggtagagttacggtcggccggtacggacagtcgacggtaccgtcgtacggaccacgacccgaacggccgtaccgtcccccgtcggtaccacccgtccgttcccgtcccccgacccttccctacgtacgtacgtaccgg

SEQ ID NO: 398017 - DNA, 546 bp, Homo sapiens
  misc_feature: GZ8MTXP02GYZ74.13.33.C11.1.454.CMB.2.raw
  modified_base (349)..(349): a, c, t, g, unknown or other
  modified_base (485)..(485): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagccgtggggcctcagtgaaggtctcctgcaagacctctggatacaccgtcacccgacgaccatatatacgtgggtgcgacaggcccctggacaaggccttggagtcggagtgggacatatcagccctgtcagtgtnaccactaaagttgcacagtacttcgagtacgagggtcacatagaccgacggacacgtaccactacaacgacacgacctacagtcggaactaggagacggtacaagatcacgacgacacgtacgttacttagtcgtnactaaataacgtaattacgacaaacgaagttgtatttgattagtcggtacggggtaaccgg

SEQ ID NO: 398018 - DNA, 685 bp, Homo sapiens
  misc_feature: GZ8MTXP02HQQRV.13.33.C11.1.454.CMB.2.raw
  modified_base (355)..(355): a, c, t, g, unknown or other
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagtccttcggacgaccctgtcccctcagttgtaatgtgtctggtgctacctaagtgactactactacgtgggctggatccggcacgcccccgaggggaacgggcgtgggaggggtagttggggatatcgtacttagtaggtggagtacgaactacaactccgtcctanaagagtccgagtcatcatactcgagacaggtaccaggtaactaattcctaccctagtaaaagtggtagtttcgtagtacggtaccgtacgacgaacgaccgacggtctacggttacttaagtttagttttggacgacggtaacggacgaaaccgtaaagttacgtacgggttaccgaaggggtacgtttaccggtaactacggggttaccgggggacccgtaaacgggggtaaacccccttcggggtacccgtaaccccggttcctttaaccccgcgtaccggtacccccgtacccaaccccggttaaaaccggcccccgtttaacccgg

SEQ ID NO: 398019 - DNA, 651 bp, Homo sapiens
  misc_feature: GZ8MTXP02JRNT0.13.33.C11.1.454.CMB.2.raw
  modified_base (486)..(486): a, c, t, g, unknown or other
  modified_base (497)..(497): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagcctggggcctcagtgaaggtctcctgcaagacctgtggataccaccgtcaccgacgaccatatatacgtggtgcgacgacggccccctaggacaaggtccttaggacggtaggagtgggactatactaccgagcccctgtcccgaggtgggtcaccgaactaaaggtttcgactacgtaaacgtaacctttcgaacggtaacgtacggggtaccaacctagtacgacccgaacggactacccgtacaacgtaccaaacacacgaccctaanagtaggaacgnggacggacgtacctaagacgtaccgtaggaaccgaacggtaccggttaacgttttagttaacgttggtaacgaactaaagtaaagtaacgttaggaactaaaacggtaattggttaacttttgaaagtttagtacggggttagggtaaacccgg

SEQ ID NO: 398020 - DNA, 653 bp, Homo sapiens
  misc_feature: GZ8MTXP02HHVGS.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactacgtgggctggactccggcacggcccccgaggggaacgggcgtgggagtggagttggggatagtcgtcttagtaggtgggagtacgaactacaactcccgtcctactagacgtcgagtcatcatactccgtagacaggtaccgagaacgacttccaccgtaagaaacgtgagtttctaggtcgcccggtgacgaagaccgtacggcttagtacttacgtttagttggtcgacgagaccggtataaaagttcgtagggttacgaagggggtacgtttaccggaaacgttaccgggttaggggaccccggaaacgggggtaaacccctcggggtaacctacccgggttcctcccgttaccgaaccggtcccctaaccccgaacccggaaacggggtccccc

SEQ ID NO: 398021 - DNA, 642 bp, Homo sapiens
  misc_feature: GZ8MTXP02GM8YO.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatgggcctgtcccagctgcagctgcaggagtcgggcccaggagtggtgaagccttcggagaccctgtccctctagttgtaatgtgtctggtgctcctaagtaggactacttacgtacgtgggctggactccggcacgcccccgagggaagggcgtggagtggagttgggatatctacttagtagtggagtacgaactacaactccgtcctacgaagacgtacgagtacatcgatatccgtagacacggtaccaaggtaacgaactttcctacccgtaagtaaagtgtacgtttcgtgtacgtaccgtcgactagacgtaccgcttgttacttaagtttagttcgtaggacgaacgtacggaactaaaagttagtacggttacgaaggggtactttaccggaacttacgggttcggggaccgtaaaccggggtacccgttacggtcccgtaacccgtccgttcccgtacgaccgtaccctaccccgaaccggtaacgggaccccc

SEQ ID NO: 398022 - DNA, 560 bp, Homo sapiens
  misc_feature: GZ8MTXP02G1GRW.13.33.C11.1.454.CMB.2.raw
  modified_base (447)..(447): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctctgcaagacctctggataccaccgtcaccgacgaccatatatacgtgggtgcgacacggccccctggacaaggccttgagtggatgggacatatcacgtccctgtcaggtggtcgccactaaagtttgacacagtacttcaggacagggtcacatgaccgacggacacgtaccatcaaacacacgacctacagtgaactgaggacgactaagatacngaaccgacaccggtcgtttaattacgttgagtactaaaataagtaaattacggaacaaacggtatgttacgtttaagaattacgtagggtacggggaccaaggggtactaacg

SEQ ID NO: 398023 - DNA, 744 bp, Homo sapiens
  misc_feature: GZ8MTXP02HBLRC.13.33.C11.1.454.CMB.2.raw
  modified_base (225)..(225): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtgggcctnagtgaaggtctctgacaagacctcgtggatacaccgtcaccgacgacatactatacgtggtgcgacgacggcccctaggaacgaacggtccgttaggagttgggagtacggggtaacattacgtaccgacgtcccctggtaccccgtaggtcggttacgacccgtaaacgttaaaacggtttcgacccgtaacgtaaacggttaaaccgttttacggaacggggtaaccgtacgggggttacccaaacccgtagttaaacccggaaccccgtaaccggggaaccctaacccgggttaccctaaaccgtaaccaaaacccgaaccgaaccgtaccctaaaacgtacggttaacggaaaccgttagggaacggtaacgtaacccgttaaagacgttacgtacggaaccgtaaccgtaccggttaccgtttaatttacgtaggtactaaactaaaggtaacgtaagttaacggaacctaaaaggttgttacgttacgttagtagtacggtacggacggaacg

SEQ ID NO: 398024 - DNA, 815 bp, Homo sapiens
  misc_feature: GZ8MTXP02HN2HZ.13.33.C11.1.454.CMB.2.raw
  modified_base (224)..(224): a, c, t, g, unknown or other
  modified_base (291)..(291): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagcgtgggcctnagtgagtctctgacaagacctcgtagactacaccgtcaccgacgaccatatatacgtggtcgcgacncggccctggacaaggcctggagtggagtgggactatactcgacgtcccgtgtccgagggttcggtcgacccgtaaagttaaacggtttcgaccgtaaacgtaaacggttaaaccttttaccggaaacgggtaacgtaacgggggttacccaaaccgtaacgtacccggaacccgaacccgggtaaaccgtacccggttaacccaacgtaaacccgaaaacccaccgaaccggtaacccttaagaaccggtttaaacggaaaccgtttagggaaacgggtacgttaaaccgtaaacggttacttaccggttaacggaaacccggtaacggttaacccggggttttaacccgttttaaacgttttaacgggtttagtaaccggtaaaccgtttaaaaaggttaaaaccgttaaaggtttaaccgggtaaaacccttaaaaacggttaacgtttaggttttaaccgttttttaaacggaaccgttttaaaaggttccggggggtttaacggggtaaaaccccggggg

SEQ ID NO: 398025 - DNA, 633 bp, Homo sapiens
  misc_feature: GZ8MTXP02JYPOB.13.33.C11.1.454.CMB.2.raw
  modified_base (196)..(196): a, c, t, g, unknown or other
  modified_base (214)..(214): a, c, t, g, unknown or other
  modified_base (446)..(446): a, c, t, g, unknown or other
  modified_base (473)..(473): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtggccccgganagacggccacaattcccngtgaggaaacaccttagaagtcagaatgccatggtaccagcagaatcaggccaggcccctgtggtggtcatcgtaataggggataacgaacccggccctcgtgggactcccgtgaccgattcctctggcctccccaacgtcggggaaccacggcccacccgtgacccactaccaaacacgaacgccccgaaagggtaccggggatggaaggctagacttatactgtcgaggngtggacaggcaagcacgtcgccccgtntacgtcgtacgttccgggaacttcgggaacctaaacggtcctaacccgtacctaaacggtaccaacggccccgaaaacgggccccctaaaacccccggtcttaaccggccctaacccgttccgtttacccgttccccccggaccctttccctttaacccg

SEQ ID NO: 398026 - DNA, 561 bp, Homo sapiens
  misc_feature: GZ8MTXP02I1VIR.13.33.C11.1.454.CMB.2.raw
  modified_base (341)..(341): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggagtggacatatcagccctgtcagtgtgccanaaagtttgcacagactttcaggacagggtcacatcgaccacgacacgtacatcaaacacagcctacataggaactggaggacgcctaaggactctagacgacacgggtacctttaagttattagtcgtacaaacgtaaagtaattacggactaaaacgtacgttagtaccgttttaagaagttagttaggtacggggacccgtaaaggggtaactaacgg

SEQ ID NO: 398027 - DNA, 630 bp, Homo sapiens
  misc_feature: GZ8MTXP02I027A.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtcctcagttgtaatgtgtctggtgctccctaagtagactactactacgtgggctggactccggcacgcccccgagggaagggctggaggtggagttggggatatcgtcttagtaggtaggagtacgaactacactccgtccctacaagacgtcgagtcatacatatccgtagacgaggtccaaggaacgtaacttccgtacccgtagtaaacgttgtaacgtttcgtagtacgtacccgtcgccgaagaaccgcggtacgttgttaccgttaatttagttacggtgggaccgtaaggaccggtaactaaagttagtgggtttacgaggggttacgtttacgacgttacggtcgggggacctacggggtacccgtacgtcctaccggtctcccgtacgaccgtcctacccgaccgaacgggtcccc

SEQ ID NO: 398028 - DNA, 770 bp, Homo sapiens
  misc_feature: GZ8MTXP02FJEAW.13.33.C11.1.454.CMB.2.raw
  modified_base (235)..(235): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtgggctgaggtgaagaagcgtgggcctcagtgaggtctctgcaancggggggtctggatacaccgtcaccgacgaccatatatactgggtgcgacacggcccctaggacgaaggccgttgagtggagtggggacctagtatcgacgtccccttgtcgtaaggtcggtccgaccctaaacgtaaaaggttttcgacgtaacctaagggtaaccttttacgaaacgggaaccggtacgggggttacccaaacccgacgtacggaaaccccgaaccggggaaaccctaaacccggttacccaaacgttacccaaaacccaacccgaacggtacccctaacgtaaacgtaacgggtaaaacccgttgggaaaacggggaaccggtaaccgttaaaacgggtaacttaccgttaacggaaacccgggtaaaccgtaacccgggggttaccctttttaagtttaaccgttgggtaaccgtaactaaaagttaaacgtaaagtttcggaaactaaaaaccgtcgtaggtttactttaaggtaattaacggtgggttaacgggggaactaacgggggacttaaccggg

SEQ ID NO: 398029 - DNA, 770 bp, Homo sapiens
  misc_feature: GZ8MTXP02IF1ZV.13.33.C11.1.454.CMB.2.raw
  modified_base (333)..(333): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctgagtgaaggtctcctgcaagcctcgtggatacaccgtcaccgacgacatatatacgtggtgcgacacggcccctaggacaaggcctaggagtggagtgggactatacncgagtcccctgtaccgagtcggtcgacctaaacgtaaaggtttcgacctaacgtaaacggttaaaccgtttcgaaacggggtacgtaaacgggttacccaaaccgtaacgtacggaaccccgaaccgggtaaccctaacccggttacccaaacgtaaccgaaaaccgaccgtaaacgtaccccgttaaaaccgaacggtttacgggaaacgttacgggaaacgggtaaccggtaacccctaaaggtacgttaaccgttaacggaccgtaaaccgtacccggggtttaccgttttaaacgtttacgtttagggtaccgtaaacttaaaaacggttaaaacgttaaaacgtttacggaaacctaaaacggtaagtttaccggtttaacttttacggtaaaagtttacggtaacgggggtttaaccggggaaacccgggg

SEQ ID NO: 398030 - DNA, 668 bp, Homo sapiens
  misc_feature: GZ8MTXP02FGXYC.13.33.C11.1.454.CMB.2.raw
  modified_base (276)..(276): a, c, t, g, unknown or other
  modified_base (337)..(337): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaaacagccacaggacgcccactcccaggtgcagctggtgcagtctggggctgaggtgaagagctgggctcagtgaggtctctgcaagacctctggatacacgtcaccgacgaccatatatacgtgggtncgacacggcccctaggacaaggcctgagtggagtggacatatcagtccctgcagtggtacncctaacaaagtttcgactaacacgttaaccttcgaaacggtacgaagggggttcccaacgactacggaacccgaaccgggaaccaccgttaccaacgtacccgaaaacaccaacgacccttaaacaacgttacggaaaacgttgggaaacggacggaacccggttaaaagaacgttacgtaacggaaccgtaacgtaacggttcggttaacgtttaatttacgttagttacggtaaactaaaagttaaacgtaacgttaacgaaacgtaaaacgtagttacgttaagtttagtaacgttaggtacggggtacggggaaccgtaacgggaac

SEQ ID NO: 398031 - DNA, 660 bp, Homo sapiens
  misc_feature: GZ8MTXP02IA9K1.13.33.C11.1.454.CMB.2.raw
  modified_base (293)..(293): a, c, t, g, unknown or other
  modified_base (299)..(299): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgccagctggtgcagtcgtgggctggaggtgaagaacgccgtggggcctcagtggaaggtctcctgcaacgacctcgtggataccaccgtcaccgacgaccatatatacgtggngcgacnggcccctggacacggccttggagtggatgggacatatcgacgccctgtcccgaggtggtacgaccgaacgtaaagtttcgcctaacgtaacgtaaacctttacgaacgggtacgaacggggtacaacccgtagtccgaacccgacggaaccaacccggtacctaactaccaaaacaccgacgaccctaactaagttacgggaaacgttagggaacgggacgaaccgttaagacgtacgtacggaaccgtaccgtacgggttacctttaagttagttacggtagtaactaaagttaaacgtaagttcgaaacgtaaacgtaagtgttacgttttagacgttacgtggttaacggggaaccgg

SEQ ID NO: 398032 - DNA, 695 bp, Homo sapiens
  misc_feature: GZ8MTXP02JSILU.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacgaggacgcccactcccaggtgcagctggtgcagtcgtggggctggaggtgaagagccgtggggcctgagtgaaggtctcctgacaagacctcgtggatacaccgtcaccgacgaccatatatacgtgggtgcgacgacggcccctggaacaggtcctagacgtggagtgggacagtactacgacgtcccgtgtccgtaggtcggtacgacccgaacgttaaaagtttcgacctaaacgtaacgtaaaccgttttacgaaacgggtaaccggaacggggttacccaaacccgtacgtacggaaacccgaacgggacccgaacccggtaccactaacccaaaccacaccgtaccctaagaacgtacggaacgtaggaacgggacgtaaccctaaagtactaccgtacgaaccggtaacgtaccgggttaccgtttaagtttacgttagtacggtaactaaaagttaaagtaacgttacggaaactaaacggtaagttacgtacgtttagagttacgtacggggtacggaaaccggg

SEQ ID NO: 398033 - DNA, 713 bp, Homo sapiens
  misc_feature: GZ8MTXP02GMBVA.13.33.C11.1.454.CMB.2.raw
  modified_base (200)..(200): a, c, t, g, unknown or other
  modified_base (221)..(221): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagtcttctgtcggcctcctatgagttgactcagccactctcagtgtcaggtcggccccgganaggaccggccacaacttcccngtacggaagggaaaccaacgttagaagtcaagaatgtaccagtcgtacagcagaagtcaggccacggccctgtggtgtcatctagtagggataacgtaaccggccctcgtacgggactcccgtagaccgtattctcgtcggtcctaccccgtaacgtaccggggaaccaccggacccacccgtcgaccacgtaccaaacgacgaccgaccgaaagggaccggggaatcgggaacggtctacggtaacttaacgttacgtacggtacgaaggggtacgggtacgggaacgacggacaacggtacctaaccgtccggcccgtagttacgttcgttaccgttacgggtaaaccgtcgggaaccgtaacggtaccgtaacccgttaccgtaacgtaccgaacccgaacccgaaccggtaccccctaaaccccgtacgttaaccgtacctaaccttaccggttacccgttcccccgacccgtttaccgtttaacccg

SEQ ID NO: 398034 - DNA, 782 bp, Homo sapiens
  misc_feature: GZ8MTXP02HPNEF.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctcgagtgaaggtctcctgcaacgacctcgtaggactacaccgtcaccgacgaccagtatatacgtggtgacgacgacggcccctaggacaacggccttaggagtaggagtggggacagtacgtcgacgtcctagtcccgaggtcgtcgacctaacgtaaaagtttcgacctaacgtaagtaaacccttttacggaacgggtaacgtaacgggggttacccaacccgtaagttaccggaaaccccgtaaaccgggaaccctaacccgttacccgaaacgttaccgaaaaccctaacgaccgtaacccaaaccgtaacgtaacgggtaaacccgtagggttaaacgggacgggttaacccgaaaggtaaccgttcgtaacggtaaccggaacccgtaccgggggtttaaacccttttaagtttaacgtttaacgggtagtaacctaaaaagtttaaaagttaaaccgtttaagggaaaccctaaaaggttaaccggttaactttcggtttttaaacgaacgttttaaacgggtggggtttaacgggggtaaaacccggg

SEQ ID NO: 398035 - DNA, 677 bp, Homo sapiens
  misc_feature: GZ8MTXP02JWE7A.13.33.C11.1.454.CMB.2.raw
  modified_base (227)..(227): a, c, t, g, unknown or other
  modified_base (251)..(251): a, c, t, g, unknown or other
  modified_base (373)..(373): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagaagccgtggggcctnagtgaaggtctcctgcaagacctntggactacaccgtcaccgacgacatatatacgtgggtgacgacacggcccctggaccgaaggccttaggagtggagtgggacatatcgacgccctgccgaggtgtcgaccaacgtaaagttnaccgtacaagtaaccgtttacgaagacgtacgggtaccaccgtacgtacgaacccgtaacggacctaaccgtaccctaacgtaccaaaacaccgacgtaacccttaaacgacgttaacgggaaaccgttagggaacgggacgtaaaccgttaaacgacttaccgtaacggtaaccgaccgttaaccgggttaccgtttaaagtttacggtttaggtacgtaacgtaaaagttaaagtaaacgttacgaaccgtaaaaagtgtacgtttacgtttagaacgttagtacggggtacgggtaaccgg

SEQ ID NO: 398036 - DNA, 546 bp, Homo sapiens
  misc_feature: GZ8MTXP02FFJQU.13.33.C11.1.454.CMB.2.raw
  modified_base (189)..(189): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtncagtctggggctgaggtgaagaagcctggggcctcagtgaaggtctcctgcaagacctctggatacaccgtcaccgacgaccatatatactgggtgcgacaggcccctggacaaggccttgagtggatgggacagtatcagcccctgtccagtggtgaccacaaagttgcacagaactttcagtacagggtacaccatagaccacggaccacgtaccatacaaacacaacgtcctaacagtaggaacgtgaagggacgacctaagactctagacgacacggtccgtttaattattcgtagactaaataaagaattacgacaaaacgaatagtactttagatagtggtacgggaaccg

SEQ ID NO: 398037 - DNA, 677 bp, Homo sapiens
  misc_feature: GZ8MTXP02JAYWZ.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttctggtggcaacagccacaggagcccactcccaggtgcagctggtgcagtcgtgggctggaggtgaagaagccgtggggcctcgagtgaaggtctccgtgacaagacctcgtggataccaccgtcaccgacgaccatatatacgtgggtgccgacacggcccctggaacaaggtccttggacgtggagtagggacagtactcgaacgcccgtgtccgtaggtggtcgaccaacgtaaagtttcgacaacgtaacgtaaaccgtttacgaagggaacgacggggtccaaaccgagtacgacccgaacggacaaccgttaccactaccaaacacaacgcctaacgagttaaggaaccgttaggacggacgtaaccgtaaagacgttacgtacggaaaccgtacggtaaaccggttacccgtttaaatttagttacggttagtaaacccgtaaaagttaaacggtaagtttaacgggaaccctaaaaggtaacgttaatacgttttagattaaggtcggggttaaccgggtaaaccgg

SEQ ID NO: 398038 - DNA, 510 bp, Homo sapiens
  misc_feature: GZ8MTXP02JPMDU.13.33.C11.1.454.CMB.2.raw
  modified_base (418)..(418): a, c, t, g, unknown or other
  modified_base (442)..(442): a, c, t, g, unknown or other
  modified_base (465)..(465): a, c, t, g, unknown or other
  modified_base (484)..(484): a, c, t, g, unknown or other
  modified_base (503)..(503): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatatatactgggtgcgacaggcccctggacaaggccttgagtggatggggacagtatcagcccctgtcccagtgtgccacaaagtttgcacagtaactttcaggacagggtcaccatgaccacggacacgtcatcaacacagcctanatggaactgagagacctaagatcngacgacacggtcttatatgcganaataagattcgactaaacngtcgtatttgatagtacgngggaacg

SEQ ID NO: 398039 - DNA, 607 bp, Homo sapiens
  misc_feature: GZ8MTXP02F7LZZ.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctctttcttggtggcaacagccacaggagcccactcccaggtgcagctggtgcagtcgtggggctgaggtgaagaagccgtggggcctcgaggtgaaggtcctccgtgacaagacctcgtaggataccgaccgccgaccgacgaccatatatacgtgggtgcgacacggcccctggacaaggtccttgaggtggatgggacatatcacgccctgtcgtaggtggtaccgaccaacgtaaagtttcgacaacgtacgtaccgtttccgaaggtaccgagggtaccaacgagtacgaacccgacggaccaccgtaccaataccaaacacacgacctaacgagtaggaactgaggacgaccgtaagattcgagaacgacgtacggttaccgtttattagttgtagaactaaagtaaagtattacgaactaaacgtcgtattacgtttaagattagtggtacggacgaacggactacg

SEQ ID NO: 398040 - DNA, 719 bp, Homo sapiens
  misc_feature: GZ8MTXP02JH358.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtgaagagccgtggggcctcagtgaaggtctcctgcaagacctctggactacaccgtcaccgacgaccatatatactgggtgcgacgacggcccctggacaaggccttaggacgtggaagtggggtacatactcgacgtcccctgtacgtaggttcggtacgacccctaaagtaaacgttttcggactaacgtaagtaaccgttttcgaaacgggtaccgtaacgggggttaccacccgtaataccggaaacccgaacgggaacccgtaacccggttaccctaacttaacccgaaaaccaccgtaacgtaccccttaaagaacgtacgggtaaaaccgtagggaaacggggaaccgtaacccgttaaaaggacgttacgtacgaaaccgggtaaccgtaaccgggttaccgttttaaattacgtttagtacggtaactaaaaggtaaagttaaacttaggaaactaaacggtatggttactttaagattacgtgggtacggaccgaagggactaacgg

SEQ ID NO: 398041 - DNA, 619 bp, Homo sapiens
  misc_feature: GZ8MTXP02GRCYE.13.33.C11.1.454.CMB.2.raw
  modified_base (534)..(534): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagccgtggggcctgagtgaaggtctctgcaagacctctggatacaccgtcaccgacgaccatatatacgtggtgcgacacggcccctaggacaaggtccttaggaggtggagtgggactatactcacgccctgtcccaggtggtacgaccaacgtaaagtttcgcaacgagtaactttcgaagtacgagggtaccacgtagtacgaaccgacggacaccgtaccacgtacaaacactacgacctagacgtacgaacgtaggaggaacgaccgtaaagactacgtacgaaccgacgtaccgggtacgtttaattacgttcggtanaaccgtaaaagtaaagtaacgttacggactaaaacgtaagttacgttacgttttagagtttagtacgggttacggggtaaaccgg

SEQ ID NO: 398042 - DNA, 552 bp, Homo sapiens
  misc_feature: GZ8MTXP02H9113.13.33.C11.1.454.CMB.2.raw
  modified_base (366)..(366): a, c, t, g, unknown or other
  modified_base (449)..(449): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacaccgtcaccgacgaccatactatactgggtgcgacacggcccctggacaaggccttggagtggagtggggacatatcacgccctgtccgagtggtcgcacaaagtttgcanagaactttcagggtacaggggtcaccatcgaccacggacacgtcactacaacacagctacatggaacgtgaggagcctaaagntacgtgacgacgtacggtccgtttattattggttacgactaaataaagtagtacgtacgaaacgtaatagtacgttttgtagtacgttaggtacgggtaacgg

SEQ ID NO: 398043 - DNA, 704 bp, Homo sapiens
  misc_feature: GZ8MTXP02HFSAG.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtgggctggaggtgaagaagccgtggggcctcgaggtgaaggtctctgacgaagacctcgtggactacaccgtcaccgacgaccatatatacgtggtcgcgacgacggcccctaggaccgaaggtccgttggaggtcggagtgggacatactcgacgcccgtagtcgaggtcggtccgaccaacgtaagtttcgactacaaggtaccttagagacgacgggtcaccgatcgaaccacggacaccgtcaacgtaccaacacgacgtacccagtacgtacggaaacgtagaacgggactaacgtaaacgtactacggtacgaaccggaaccggtaaccggtttacccgttttaaatttagtttacggtaaccgtaacgtaaaagtttaaacggttaaacttacggtaaaaccgttaaaaccgtaagttaacccgttttaagttttaacggttaaacggtaaggtttacggggtaacgggggtaacccggaaaacgggggtaacctttaaaacccggg

SEQ ID NO: 398044 - DNA, 643 bp, Homo sapiens
  misc_feature: GZ8MTXP02FR6WA.13.33.C11.1.454.CMB.2.raw
  modified_base (280)..(280): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagagcctggggcctcagtgaaggtctctgcaagacctcgtggatacaccgtcaccgacgaccatatatacgtgggtncgacacggccccgtggacaaggccttgagtggagtggacatatcacgtccctgtcagtggtcgccactaaagttcgacacagtactttcgaggacgagggtacaaccgatacgacccgacggaccacgtccaataccaaacacacgacctaagacgtagaacgtaggaacgacgacctaagacgttaccgaacgaccgaccgtaacgggttaccgttttaagttacgtttagtagtaaacgtaaagttaaaggtaaactttaaggaaacccgtaaaacgttaacgttacgtttaccgttttaagaagtttaaacgtttacgggggtaccggggtaacccggaaaaggggtacccttaaaacgg

SEQ ID NO: 398045 - DNA, 754 bp, Homo sapiens
  misc_feature: GZ8MTXP02GZY8A.13.33.C11.1.454.CMB.2.raw
  modified_base (199)..(199): a, c, t, g, unknown or other
  modified_base (218)..(218): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcggccccggganagacggccaacaattcccngtgaagggaaacaacttagaagtcaagaatgtccactggtaccagcagaagtcaggccacggcccctgtggtcggtcatctagtagggataaacgtaaccggccctcgtcgggaactccccgtaggacccgtattccgtctacggcctaccccgaacgtaccggggaaacaccgggacccacccgtcgacccactacaaacgacgaacgaccccgaaaaggtacgggggaataggaacggctagacttagtttaatcggttacgaggggttgtacggggtaacaacggaccctaaacggtaccgggttagaacgtttaacgggttccggggaccggggtaccgggggaaaccgaaacggtccggttacggtaaaccccggttccgtaacggggttaccaacccgggtaccccgaaacgggtccccgttcccggacccccccgttaccgggtaccctaacccgtttcccggttcccggtttacccccccgtacccccttcccggtttaccttaaccggggtttaaccggttacccgg

SEQ ID NO: 398046 - DNA, 696 bp, Homo sapiens
  misc_feature: GZ8MTXP02GA2EO.13.33.C11.1.454.CMB.2.raw
  modified_base (255)..(255): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagccgtggggcctcgagtgaaggtctctgcagcctgtggatacncgtcaccgacgaccatatatacgtggtgccgaacacggccccctggaaccaacggccttaggagtggagtgggacatactcagtccctgtccaggtggtacgaccaacgtaaagtttcgctaactaacgtaaacctttcgaacgggaacgtacggggtaccaaccgatacgaacccgaacgaccgtaaccgtaccaactaccaaaaccacgaacaccgtaaacagttacgggaaaccgttaggaacgggaacggtaccgtaaaacggtacgtaccgtaacggaaccgtaacggtaaccggggtttaccttttaaaagtttagtttacggttaacgtaaacgtaaaacgttaaaacgtaaagtttacgaaaaccgttaaaacgtaacgttagttaacgtttttacggaacgtttaggtacggggttacgggtaaaacccggg

SEQ ID NO: 398047 - DNA, 666 bp, Homo sapiens
  misc_feature: GZ8MTXP02JOK19.13.33.C11.1.454.CMB.2.raw
  modified_base (243)..(243): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtgggcctcgagtgaaggtctctgacaagctntgatacaccgtcaccgacgaccatatagtacgtgggtgacgtacgacggcccctaggaacgaggcctttaggaggtcggagtgggaacagtactccgagccccgttagtcgaggtggtaccgtcccaagtaaagttcacgacgaacgtactttcggaaggtacgtaggggtaccaaccgtagtaccgaacccgacggaacccacgtccaataccgaactacacgtacccaagagtacggaaacgtggaaacgggtactaccgtaaagacgttacgacggaaccgtacccgtacggttaccgtttattaagtttaccgacgtaacgtaaagtaaacctaaggttacgacccgtaaaagtccgttaagttacgtttaagaacgtttagtacgggtacggggacccgtaaaggtacccgttaacgg

SEQ ID NO: 398048 - DNA, 691 bp, Homo sapiens
  misc_feature: GZ8MTXP02FRRRW.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagaagccgtggggcctcgagtgaaggtctcctgacagacctctggactaccaccgtcaccgacgacctatatatacgtggtcgcgacgacggcccctgggaaccaaggcctttggaggtcggagttacggggactatactcgacgtccccgttagtcccgtaaggttccggtacgaccccgtaaacgtaaaacggtttcgccgtaaacgtaaacgggttaaacctttccggaacgggtaacgtacggggttacccaaccgtagtaccgaacccgacggacctaccgtaccacgtacaaaccacacgctaaccgagtacggaacgtaggaggaacgacctaaagcttacgacggaaccgacgtaaccggttccgtttaagttacgttacgttaggaactaaaagttaaaggtaaccttaggaaacctaaaacgtgttaacggttttacgtttaacggtagttacggtacgggtaccggtaacg

SEQ ID NO: 398049 - DNA, 662 bp, Homo sapiens
  misc_feature: GZ8MTXP02HNWYN.13.33.C11.1.454.CMB.2.raw
  modified_base (224)..(224): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagccgtgggcctnagtgaaggtctctgcaagacctctggatacaccgtcaccgacgaccatatatacgtgggtgcgacgacggccccgtagggaacaacggtccttaggacggtggagtgggactatatcgacgtccctgtcccgaggtggtcgacctaacgtaaaggtttcgaccaacgtaaacgtaacctttacgaacgggacgaaggggttacccaccgtaagtaccggaacccgaacggacctacccgtaccaactacaaccaaccacgacctaacgagttacggaaacgttaggaacgggacgtaaccgtaaacgtacttaccgacggtaaaccgaccgtaccgggttaccgttttaatttacgttaggttacgaaactaaagttaaacgtagttacgaacaaacgtaagttaggttactttagattaggtagggtacgggaacgg

SEQ ID NO: 398050 - DNA, 608 bp, Homo sapiens
  misc_feature: GZ8MTXP02GNO45.13.33.C11.1.454.CMB.2.raw
  modified_base (197)..(197): a, c, t, g, unknown or other
  modified_base (227)..(227): a, c, t, g, unknown or other
  modified_base (248)..(248): a, c, t, g, unknown or other
  modified_base (373)..(373): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgnggggctggaggtgaagagccgtggggcctnagtgaggtctctgcaagcctntgactacaccgtcaccgacaccatatatacgtgggtcgcgaacgacggcccctaggacaaggccttaggaggtcggagtgggacatactcgacgtcctgtccagtgtcgacctaagtaaacgttnactacaacgttaaacttgaacggtacgacgggtaccacagtacgaaccgacgacacgtacactacaaacactacgacctaacgtaagacggaaacgtaggaacggaacgacctaaagagtacgtacgaacgtaacgaccgggtttacttagttacgttacgtagaaactaaagtaaagtacgtaacgacgaaacgtaagtcgttacgtttagacttaggtcggtacgggtaaacg

SEQ ID NO: 398051 - DNA, 545 bp, Homo sapiens
  misc_feature: GZ8MTXP02F5RAG.13.33.C11.1.454.CMB.2.raw
  modified_base (209)..(209): a, c, t, g, unknown or other
  modified_base (323)..(323): a, c, t, g, unknown or other
  modified_base (343)..(343): a, c, t, g, unknown or other
  modified_base (356)..(356): a, c, t, g, unknown or other
  modified_base (412)..(412): a, c, t, g, unknown or other
  modified_base (418)..(418): a, c, t, g, unknown or other
  modified_base (426)..(426): a, c, t, g, unknown or other
  modified_base (474)..(474): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagtccacaggagcccactcccaggtgcagctggtgcagtctggggctgagggtnaagagcctggggcctcagtgaaggtctcctgcaagacctctggatacacgtcaccgagaccatagtatactgggtgcgacaggcccctggacaaggccttgagtggatcggganatatcagcctgccagtggtnaccataaagtttncacagtaaactttcgagacaggtacaccatgaccagactacgaccatcaacacgancctaanaccagacngacgacgactaagctacgagacgacgtacgtacgtttatacgttgtanaacgtaaagtaaagtaacgtacgtaacgtaacgtaagtacgttacgttacgtagtacgtacggtacggacg

SEQ ID NO: 398052 - DNA, 688 bp, Homo sapiens
  misc_feature: GZ8MTXP02IUAMB.13.33.C11.1.454.CMB.2.raw
tcagtcacgtactacacgaccggtgctcgatttagagtgagctcgttgggtttggggatgctttctgagagtcatggatctcatgtgcaagaaaatgaagcacctgtggttcttcctcctgctggtggcgctcccagatgggcctgtcccagctgcagctgcaggacgtcgggcccaggagtggtgaacgccgttcggacgtaccctgtccctctagttgtaatgtgtctggtgctaccctaaggtagacttacttacacggtgggctacggactccggcaccggccccgaggggaacgggcgtagggagtggtagttaggggattatccgttattagtaggtagggaagtaccgtaacttaccaacgtcccgtaccagtaacggtacgtacgacgtcatactaacgttactccgtagaacacggtacccgaaggaactaaactttccctaaccgtagtaaagtagtagttacgtggtacgaccgtcgacgacgacgacggtcgttagttacttatttaagtcggtacgaaccggtagtacccggtaataagttagtcggtacgtagggtaacgttcgaaacggttcggtacgggtaccggaacgggtaccccgttaggtccccgttaaaccggtccgttaccctacgtaacccgcccgttaacccgaccggtaacccgggtaccccg

SEQ ID NO: 398053 - DNA, 609 bp, Homo sapiens
  misc_feature: GZ8MTXP02IN6J9.13.33.C11.1.454.CMB.2.raw
  modified_base (569)..(569): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttctggtggcaacagccacaggagcccactcccaggtgcagctggtgcagtcgtgggggctggaggtgaagaagccgtggggcctcagtgaaggtctcctgcaagacctctggatacaccgtcaccgacgaccatatatacgtgggtgcgacgacggcccctggaaccgaaggcccttaggagtggagtgggacatatcacgccctgtcccagtggtcgaccaacgtaaaggtttcgactaacgaacgtaaaccgttttacgaacggggtaacgacggggttaccaaacccgtagtaccggaaacccgaacgggaaccaaccgttacccaactaaccaaaccgaaccacgaccctaacagtagaacgtagagggtacacgtaagatcgtagacgactacggtactttattagtgtacgactaaataanatacgacaaagaagtgtctttagatagtcggtagggaacg

SEQ ID NO: 398054 - DNA, 659 bp, Homo sapiens
  misc_feature: GZ8MTXP02IID4C.13.33.C11.1.454.CMB.2.raw
  modified_base (200)..(200): a, c, t, g, unknown or other
  modified_base (364)..(364): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcgggccccggganaggacggccactaacttccctgtagaagggaaacaacttagaagtcagatgccatgtaccagcagaatcaggccagccctgtggtggtcagtctagtagggataagtacccgcctgtagggactcccgtgaccgattctcgtgctaccccgaacgtcgggaacncggcccaaccgtcacctataccaaacgagaccgacccgaaagggacgggactgacggccgtagtaaccgttaatttagtcggtcgaagggttggacggggaacagtacccgaacgtaccgggtagtaattacgggtaccggggcgggacccgggaaacgaacggtccgttacggaacccggttcgtaacggttaccgaaccggtcccgaacggtcctacccgggcccccgttaaccggttcacccgttccgtccccgttccccggccccttacctacgttaccggacgttcccgg

SEQ ID NO: 398055 - DNA, 682 bp, Homo sapiens
  misc_feature: GZ8MTXP02GLAZL.13.33.C11.1.454.CMB.2.raw
  modified_base (197)..(197): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcagtcggcccggganagacggccactaacttccctgtagaagggaaactaaccttaggaagtcaagaatcgtccacgtggtaccagcagaacgtcacggccacggcccctggtggtggtcatctagtagggataacgtaaccggccctacgtgggactcccgtcgtaccgtattcctcgtcggcctaccccgaacgtccggggaacaccggggccacccgttcgacctacacaaaccgagaccgacccgaaaggggaccgggtataggaacggtctaggtacttaatttagtaggttacgaggggtaggtacggggactacggacaacggacggttagacgttacgggtcgggaccgggaccgggaacaacggcctacggtacccgtacgtacgggtacaccggacccgtaacggtcccgtccggtcccccgttacggtccctaaccgttcccgttccgtaccccctacccgttccctacgtaccggtttaacggtccgg

SEQ ID NO: 398056 - DNA, 794 bp, Homo sapiens
  misc_feature: GZ8MTXP02HS9LM.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggagatcctcttcttggtggcaacagccacaggacgcccactcccaggtgcagctggtgcagtcgtgggctggaggtgaagacgccgtgggcctcgagtgaggtctcctgacaacgtacctcgtaggataccgacccgtcgaaccgaccgaccaatatatacgtggtcgcgacgaccggcccgtaggacgacggtccttaggacgtggagtagggacgtatacgtccaacgtcccgttgtacccgtaggttcggtacgacccgtaacgttaaaacggtttcgaccgtaaccaaacggtttaaaccgtttccgtaaacggggaacccggtaaacggggttaccccaaacccgtaaacgttacccggaaacccccggaaaccggtacccgtaaaccccggttacccctaaaccggttaaacccaaaacccgtaaaccggaacccgttaacccccgtaaacgtaacggtttaacgggtaaaaccggtttagggaaacgggtaaccggtaaaccgtaaacggtaacttacgtaacgaccggtaaccgtaccggttaccgttttattaacgttacgtagtaacgtaaagttaaacgtacgttacgtaaccggtaaattaacgttacgttacttttaggacgtttacggtacggggttacggaaaccggg

SEQ ID NO: 398057 - DNA, 626 bp, Homo sapiens
  misc_feature: GZ8MTXP02IPGI6.13.33.C11.1.454.CMB.2.raw
  modified_base (376)..(376): a, c, t, g, unknown or other
  modified_base (402)..(402): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagaagccgtggggcctcagtgaaggtctcctgcaagacctcgtggatacaccgtcaccgacgaccatatatactgggtgcgacgacggcccctggaaccaaggcctttaggagtggagtgggacatatcacgccctgtccagtggtcgccacgtaaagtttcgcaanagtactttcgaggacagggtcaactnacgaccacggacacgtaccatacaaacacacgacctaacagttacggaaactaggtaacggacgtaacccgtaagtactacgtacggaaccgaacgtaccgggttacgttttaagtttacgttaggttagaacctaaaagttaaaagtaacgttaacgtaacctaaaacgtaagttcgttaacgttttacggaatttacggttacgggttacggggtaaaccgg

SEQ ID NO: 398058 - DNA, 796 bp, Homo sapiens
  misc_feature: GZ8MTXP02HX8OI.13.33.C11.1.454.CMB.2.raw
  modified_base (288)..(288): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgtggggctgaggtagaagacgcgtgggctgagtgagtctcgtgacacgcctgtagacacgaccgtcaccgacgaccatatactacgtgggtcncgtacgaccggcccaggacgaccggtcttaggaggtggagtagggactagtactcgaccgtccgtgtccgtaggtacgtcgacctaaagtaacgttgacctaacgtaacgttaccgtttacgaacggtacgtaacgggtacccaaccgtagacccggaaacccgaaccggtaccgaaccccgttaccgaaccgttaaccgaaaacccgtaacccgaaacgtaccccgtaaaacggtacggtttaaaccgggaaacccggtaggggttaaacccgggaaacgttaacccgtaaaaggtacccgttaaccggtaaccgggaacccggtaaacccggttaaccgggtttacccgtttttaaaactttaggttaaacggttacggttaaaaacctaaaaggttaaaacggtttaacgttaaccgtaaaacccgttaaaacgttaagtttaccgggtttaactttttaggaaacgtttacgggtttacgggggttaaccgggggaaaacccgg

SEQ ID NO: 398059 - DNA, 722 bp, Homo sapiens
  misc_feature: GZ8MTXP02FOBI2.13.33.C11.1.454.CMB.2.raw
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctggaggtgaagagccgtggggcctcgagtgaacggtctcctgacaagacctcgtggatacaccgtcaccgacgacatatatacgtgggtagacgacgacggccccgtaggaaccgaacggtcctttaggaggttggacgtagggactagtactcgacgtcccgtgtcccgaggtggtacgacctaaacgtaaacgtttcgaccaacgaaacgttacgtttaccgaagggtaaccgtacgggtaccaaaccgagtacgaacccgaacggactaccgtacactaacaaacgacgactcctaaacgacgttaacggaaaccgtaggaacggtaacgtaacctaaaacggtacttacgaaccggaaaccgtaccggtaaccggtttaccggttttaaattacggtttacggtaaggtaaaccttaaaaagttaaacggttaaaatttaacgaacccgtaaaaagttaaccgttacgtttaacgttttaacgtagtttaaggtacggggttacgggtaaaaccggg

SEQ ID NO: 398060 - DNA, 784 bp, Homo sapiens
  misc_feature: GZ8MTXP02HP1GB.13.33.C11.1.454.CMB.2.raw
  modified_base (228)..(228): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagcgtggtgcagtcgtggggctggaggtagaagagccgtgggcctnagtgagtctctgacaagcctcgtggactaccaccgtcaccgacgacatatactacgtgggtcgcgtaacgaccggtcccccgtagggaaccgaacggtccttaggacggtagggacgtagggaactaagttacgtaccgtaccggtccccttgggtaccccgtaggggttcgggtacccgtacccgtaaaacgttaaaacggttttcgacccgttaaacggtaaacgtttaaacctttaccgggaaacggggtaaccgtaacgggggttacccaccgtaagtacccggaacccgtacgggtaacctacccgtaccaactacccaaacgaccgaacgacctaaacgacgttacgggaactagggaaggaacccggacttaaaggaccttacggtaaccggaaaccgtaccggttaacccgggtttaccgttttaaagtttacgttacggtaacggtaaactaaaacggttaaacggtaacttaacggaaactaaaccgggtaactttagttaacggttttacgaaagtttacggttaaggggtacgggtaaacccgg

SEQ ID NO: 398061 - DNA, 614 bp, Homo sapiens
  misc_feature: GZ8MTXP02FGRIT.13.33.C11.1.454.CMB.2.raw
  modified_base (348)..(348): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctctgcaagcctgtggatacaccgtcacccgacgaccatatatacgtgggtgcgacacggccccctggacaacggccttgaggtggagtgggacagtatcagccctgccgagtgngaccaactaaagtttcgcacgaacgtaactttcgaaggtacgacgggtcaacctatacgacccgaacgacaccgtaccactacaaacacacgacctaacagtacggaacgtaggaacgggaacgaccgtaaacgactcgtaggaccgaaccgaccggttaccgtttaagttacgttagtacgtaacgaaagttaaagtaaacttacgaactaaaacgtaagttacgtttacgtttacgtattaacggtcggttacggggaaaccgg

SEQ ID NO: 398062 - DNA, 723 bp, Homo sapiens
  misc_feature: GZ8MTXP02HSP75.13.33.C11.1.454.CMB.2.raw
  modified_base (367)..(367): a, c, t, g, unknown or other
tcagtcacgtactacacgaccggtgctcgatttagagtgagctcgttgggtttggggacccagcacccacatctgtcctctagagaatcccctgagagctcccgttcctcaccatggactggacctggaggatcctcttcttggtggcaacagccacaggacgcccactcccaggtgcagctggtgcagtcgtggggctggaggtagaagaagccgtgggcctcgagtgaggtctcctgacaagcctcgtggactaccgccgtacaccgaacgaccatactatacgtgggcgcgacgtacggccccaggacaacggccttaggcgtaggacgtgggaactaagttactccgacgtccctggtaccgnggttacggacccgaaccgtaacgttaacggttcgaactacgttaacgttaccgttacggaaggtaccggtacggtaaccaaccgtacgtaccgaacccgaaccggaacctaccgtaaccgtacgtaacccgaaacgaacctaaccgtaacccgtaaacgacgtacggtaaacgtacggaacggtaacgtaacgtaagtacctacgaacgtaccgtacgttaccggtttacgtttaagttacgttagtaccgtaaacgtaaaagttaaagtaacgttaacgaaacgtaacgttacgttacgtttaagttaagtagtttacggtacggggtaccgggtaaaccggaacggtacgtacg

SEQ ID NO: 398063 - DNA, 713 bp, Homo sapiens
  misc_feature: GZ8MTXP02G1751.13.33.C11.1.454.CMB.2.raw
  modified_base (324)..(324): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtcgtggggctggaggtgaagaagccgtggggcctcgagtgaaggtctcgtgacacgacctgtaggactaccaccgtccaccgacgacctatactagtacgtgggtcgcgacgcggcccgtaggacaggtccgttgnggtggagtgggaatatacgtacgacgtcccgtgtcgtaggtcggtaccgtacctaagtaaagttcgacaacgtaacgtacctttacggaaggtacgtacgggtacctacgagtacgaaccgacgaccacgtacaactaaccaactacacgacccgtaaatacgtaccgtaaagtcgaaacgggacgtaaccgaaaggttcaccggtacgaaccgtacgtaccggtttacgtttaacgttagttacgtacgttaaacgtaaaagttaaagttaaacggttaccgtaaaacgtaacgttaacgttacgtttttaaccggtttaagttaaaaggttggggtttacggtaaacgggggttacccgaaaagggggttaacctttaaacccgggg

SEQ ID NO: 398064 - DNA, 599 bp, Homo sapiens
  misc_feature: GZ8MTXP02FGCM5.13.33.C11.1.454.CMB.2.raw
  modified_base (422)..(422): a, c, t, g, unknown or other
  modified_base (434)..(434): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctgggctgaggtgaagaagcctggggcctcagtgaaggtctcctgacaagacctcgtggataccaccgtcaccgacgaccatatatactggggtcgcgacgacggcccctggaaccaaggccttgaggtggatggggactatatcagtccctgcaggtggcgccacgaaagtttgacacagtaccttcgaaggacagggtcacgatcgaacccacggaccacgtacatcaaacnctaacgcctaanacgtaggaactgggaagacgtaaccgtaagacttcacgaacgaccgtacgggtacctttaaatgtttaggacgtaaccaaaagtaaagtaaattacgaaccgtaaaacgtacgttaagtctttaagtagttaacgtaggtacggggacggaaacggacgtaaacg

SEQ ID NO: 398065 - DNA, 689 bp, Homo sapiens
  misc_feature: GZ8MTXP02FUQX6.13.33.C11.1.454.CMB.2.raw
  modified_base (282)..(282): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggagcccactcccaggtgcagctggtgcagtcgtggggctgaggtgaagagcctggggcctcgagtgaaggtctctgcagacctctgatacacgtcaccgacgaccatatatactgggtncgacacggcccctggacaggtccttggagtggagtgggacatatcacgtccctgtccgaggtggtacgacccgtaaacgtaaaacggtttcgaccgtaaccgtaaaggttaaaccgttttaccgaaacggggtaacgtaacgggggttacccaaacccgtaagttaccggaaacccgaaaccggggtaaccaaccgttacccactaaccaaaccgacgaaccgaccctaaacgaaggttacggaaaccgtaggaacgggaacggaccctaaagacgtacgtacggaacgaaccgtacggttaccgttttaagttaacgtttggttaagactaaaagtaacgtaattacgaacgtaaaacgtaagttacgttacgttttacgatttaggtaccggtaggggtaaaccg

SEQ ID NO: 398066 - DNA, 568 bp, Homo sapiens
  misc_feature: GZ8MTXP02FOQ29.13.33.C11.1.454.CMB.2.raw
  modified_base (346)..(346): a, c, t, g, unknown or other
  modified_base (410)..(410): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctgaggtgaagaagcctggggcctcagtgaaggtctcctgcaagacctctggatacacgtcaccgacgaccatatatactgggtgcgacacggcccctggacaaggccttgagtggatggggacagtatcacgtccctgtcagtggcgccanaaagttgacacagtacttcaggacaggtcacatcgaccacgacacgtcatcaaacacagcctanatgaactgaggacgacctaagatctacgaacgacacggtcctttaagttagttagtacggtaactaaagttaaagtaaacgttgaaccgtaaaacgtactggttacttttaagaatttacggttagggacggggtaaccgaacggggtactaaaccgg

SEQ ID NO: 398067 - DNA, 650 bp, Homo sapiens
  misc_feature: GZ8MTXP02JD46T.13.33.C11.1.454.CMB.2.raw
  modified_base (325)..(325): a, c, t, g, unknown or other
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggagcccactcccaggtgcagctggtgcagtctggggctggaggtgaagagccgtggggcctcagtgaagtctctgacaagacctgtggatacaccgtcaccgacgaccatatatacgtgggtgcgacacggcccctaggacaaggccttggagtggatgggatatancacgcctgtcaggtgtccgaccacgtaaagtttcgacaacgtaagtacctttacgaacggggtaccaggggttccaacgtacgtacggaacccgaacgggaaccaaccgttaccaacttaccgaaacacacgtaccctaacgacgacggaaacgtaggaacggacgtaactaaacgtacgtacgtacggaaccgaccgtaacggttaccgtttaagttacgtttagaacctacgtaaaattaaagggtaaactttacggaaactaaacgattacgtacgtttaagaacgttagtacgggtcgggaccgtaaggggacctaaacgg

SEQ ID NO: 398068 - DNA, 876 bp, Homo sapiens
  misc_feature: GZ8MTXP02JII3N.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcaacagccacaggacgcccactcccaggtgcagctggtgcagtctggggctgaggtgaagaagccgtggggcctcagtgaaggtctcctgcaagacctctggatacaccgtcaccgacgaccatactatacgtgggtgccgacgacggcccctggacgtaaggccgtttaggaggtcgggtagtggggaacctaagtacgtaccgaacggtccccccttaggtaccgtaaggttcgggttccggacccctaaaacgttaaaaggttttccgacctaaacgaacggttaacccgttttaccgggaaacgggtaaaccggtaacgggggttacccaaacccggtttaaaacgtcccgggaaaaccccgtaaacccgggggaaaccctaaccccggtaacccttaaaccctaacccggaaaaacccaaccgtaaaccggtaacccccgttaaaacgtaaacggttaaccggtaaaccggacggggtaaaacgggaacccgttaacccggtaaaacggtactttaaccggtaccgggtaaacccggtaaccgggtttaacccgggtttaaccgtttttaaagtttacggtttaacggtaacgttaaaacgttaaaagttaaaccgttaaaacgttacgaaaacgttaaacgtacgtttacgtttaacggtttaagtaacggtttaacgggttacgggggtacggggtaaaccggttaaacgggtaccgtaacgg

SEQ ID NO: 398069 - DNA, 625 bp, Homo sapiens
  misc_feature: GZ8MTXP02IZFMJ.13.33.C11.1.454.CMB.2.raw
  modified_base (224)..(224): a, c, t, g, unknown or other
  modified_base (246)..(246): a, c, t, g, unknown or other
  modified_base (280)..(280): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggaactggaggatcctcttcttggtggcaacagccacaggacgcccactcccaggtgcagctggtgcagtcgtgggctgaggtgaagagccgtgggcctnaggtgagtctctgacagacctnagactacaccgtcaccgacaccatatatcgtggngcgacgcggccctgacagcttagagtggagtaggacatcacgcgtcctgtaccgtagtgtccgactaacttaagttcgacctaagtaacgttaaccgttacgaacggtacgacggtacaaccgtagtaccgaaccgtacgaaccgtaccctacactaacgaacacgaccgtacaactggtaacgacggtagacgtaacgacgaagttacgacgtacggacccgtacgtaccggttacgtttaacgtagttcggataaacgtaagtaaagttaacgtacgtaaacccgtaagttaaccgttagtttacgttacgttaaagtcccgttggggtaaccgggtaaccgg

SEQ ID NO: 398070 - DNA, 649 bp, Homo sapiens
  misc_feature: GZ8MTXP02FQLU4.13.33.C11.1.454.CMB.2.raw
  modified_base (199)..(199): a, c, t, g, unknown or other
  modified_base (219)..(219): a, c, t, g, unknown or other
  modified_base (298)..(298): a, c, t, g, unknown or other
  modified_base (352)..(352): a, c, t, g, unknown or other
  modified_base (378)..(378): a, c, t, g, unknown or other
  modified_base (441)..(441): a, c, t, g, unknown or other
  modified_base (508)..(508): a, c, t, g, unknown or other
  modified_base (596)..(596): a, c, t, g, unknown or other
tcagtcacgtactacacgaccggtgctcgatttagagtgagctcgttgggtttggggctgggcctcaggaagcagcatcgggggtgccgcagccatggcctggaccgctctcctgctgagcctccttgctcactttacagcttctgtggcctcctatgagttgactcagccactctcagtgtcaggtcggccccggganaggaccggccacaattcccngtagaagggaaacaaccgttagaaagttcaagtaatgtaccactggtaccagcagaagtcaggccacggcccctgtggnggtcatcagtagggataacgtaaccggccctagtgggactccctgaccgattcntcggcctacccgaacgtcgggaaacnccggaccacccgtgaccataccaaacgagaccgacccgaaagggaccggggatcggaggtacngtaacttatttaaagtcggttacgaagggttggacgggaaacgacgaccgaaccgtaacgggggttntaacgttaacgggttccgggaaccggtacgggggacccaaaggccgtacggtaacccgtccgtaacgggacacgacccggaagtcccnccgtacccccgtcggtaccacgtctccgtccccacccgtctctacgtccgtag

SEQ ID NO: 398071 - DNA, 658 bp, Homo sapiens
  misc_feature: GZ8MTXP02FJIU4.13.33.C11.1.454.CMB.2.raw
tcagtcacgtactacacgaccggtgctcgatttagagtgagctcgttgggtttggggacccagcacccacatctgtcctctagagaatcccctgagagctccgttcctcaccatggactggacctggaggatcctcttcttggtggcagcagccacagcagcccactcccaagtgctcctgaaacagtccggggctgaggtgaaagaagcctgaggcctcagtgaagtctctgcaaggcttccggataccaccctcaagtaggaaactatgtccactatgtgcgaacacggccccaaggacaagggcttactggtggagtgggggtgatacccaaacctaagtagtggagaacaacaaactatgaagaagtaaagttggagggccggtacacagtacgacgagggacacgtaccataccgaatacacgtccttacagtacggaactcgaaccgacgtaccgttcgaaccctcgtacgaaccggaaccgtaccgggtcccgttaagtacttaacgtcggtacggtacgtaaccgtaaaactacggtaacgtaacctttaaacgtttaaacgtttacgggttaacgggtttacgggaccgtaacggggtcccgtacccggttacggtcccgtaacccgttcgtacccgtcgtaacccccg

SEQ ID NO: 398072 - DNA, 620 bp, Homo sapiens
  misc_feature: GZ8MTXP02GGD5E.13.33.C11.1.454.CMB.2.raw
  modified_base (293)..(293): a, c, t, g, unknown or other
  modified_base (373)..(373): a, c, t, g, unknown or other
  modified_base (465)..(465): a, c, t, g, unknown or other
  modified_base (482)..(482): a, c, t, g, unknown or other
tcagtcacgtactacacgaccggtgctcgatttagagtgagctcgttggggtttggggggcagcacccagcacccacatctgtcctctagagaatcccctgagagctccgttcctcaccatggactggacctggaggatcctcttcttggtggcaacagccacaggagcccactcccaggtgcagctggtgcagtctgggctgaggtagaagaagcctggggcctcagtagaaggtctcctgacaaaacctcgtaggactacaccgtcaccgacgaccatatatacgtgggtncggtacacggcccctaggaacaacggtctagagtggatgggaacatatcacgcctagtcacgtgtcacaactaagttacnctacgagtaaactttcgaaggacgacggtaacaccctaatcgaaacccgtagaaccacgtacaactacaacagactcccaattagaagaacngtaagggagacctaaanactacgacgaacgaacgtaacgttacgtttacgtttagttacgtacgtaacgtaaaacgtaaaagtaaacgttaacgtaaacgaaaagtaactaagttacgtttaacgttaagtaagtacggtacggggacggaacgg

SEQ ID NO: 398073 - DNA, 750 bp, Homo sapiens
  misc_feature: GZ8MTXP02G6GHD.13.33.C11.1.454.CMB.2.raw
  modified_base (197)..(197): a, c, t, g, unknown or other
  modified_base (711)..(711): a, c, t, g, unknown or other
tcagtcacgtactacacgaccggtgctcgatttagagtgagctcgttgggtttgggggcagcacccagcacccacatctgtcctctagagaatcccctgagagctccgttcctcaccatggactggacctggaggatcctcttcttggtggcaacagccacaggacgcccactcccaggtgcagctggtgcagtcgngggctggaggtagaagagccgtggggcctcgagtgaaggtctcgtgacagcctcgaggactaccaccgtcaccgacacatatagtacgtggcgacgacgacggccccgtaggaccgacggtccttaggacgtggagtacgggactattcaccgacgtcccgtaggtacccagggtacgggtaccaccgtaaaccgttaaaaggttcggtacctaaacgtaaaccggtttaaccgttttaacggaacggggtaaaccggttacgggttaaccccgaaacccttagggtaaccccggtaaacccgaaccggggtaaaccctaaccccggtttaacccaacgttaaacccaaaccgttaaacctaccggaaaccccttaaacaacgggtaaacggtaaccgttaggaaaacgggtccgtaaaaccgttaaggacgttacgtaacggaaccgtacgtaccgtttaacgtttatttacgttaggtacaaataacgttaaacagttacgaacgtaaagtnttacgtacgtttacgagttacggtacggacggtaaccgg

SEQ ID NO: 398074 - DNA, 511 bp, Homo sapiens
  misc_feature: GZ8MTXP01DWRMI.38.4.A04.1.454.CMB.2.raw
  modified_base (269)..(269): a, c, t, g, unknown or other
  modified_base (293)..(293): a, c, t, g, unknown or other
  modified_base (388)..(388): a, c, t, g, unknown or other
  modified_base (416)..(416): a, c, t, g, unknown or other
  modified_base (470)..(470): a, c, t, g, unknown or other
  modified_base (493)..(493): a, c, t, g, unknown or other
  modified_base (498)..(498): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagcaaaaaccagggaaacncccctaaactcctgatctatggtncatccattttgactaaagtcgggtcccatcaagttcagcgcagtgatctgggaacagaatcagtctacacaatcagcagcctgcagcctaggganatactgactaacttattattggtctaanagtacttaataccgttaccccactactttcggcctaggggacctaaggttgganatacaaagactgttgcttgcacnttctnttcttcaattccc

SEQ ID NO: 398075 - DNA, 617 bp, Homo sapiens
  misc_feature: GZ8MTXP01ECX4O.38.4.A04.1.454.CMB.2.raw
  modified_base (200)..(200): a, c, t, g, unknown or other
  modified_base (246)..(247): a, c, t, g, unknown or other
  modified_base (251)..(252): a, c, t, g, unknown or other
  modified_base (296)..(296): a, c, t, g, unknown or other
  modified_base (298)..(298): a, c, t, g, unknown or other
  modified_base (301)..(301): a, c, t, g, unknown or other
  modified_base (307)..(307): a, c, t, g, unknown or other
  modified_base (313)..(313): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcgtgtaggctatttagaaggtgtcagtgtgaggtgcaatggtggagtntgggggagcttggtccaggccggggggtcctgagctctcctgtgcnnctcnntatctacttataatatatgagcgtcggcgcacgcgcgaggaggngnggnggtggngcaganataacaagagtagaacgtaagtaaaataatatagtaagtacgtcgtgtaggacgggacgtacgtacgtactactactaccgaacgaacgaacgaaaccgaaccgaaacgaaactactacgtaggtcgacgtacgacgaacgtaacgtacggaaccggacggtaggaggacgggacggaaccggaacgtacggtcgtcgttgttaacgttcgttggtcggacggaccggaacccgaccccgaccggttacgggtaacgggtacggtaacggtagggtacgggttacggtaacgttaaccgtaacg

SEQ ID NO: 398076 - DNA, 599 bp, Homo sapiens
  misc_feature: GZ8MTXP01C1Y20.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcgtgtaggctatttagaaggtgtcagtgtgaggtgcaatggtggagtctgggggagcttggccaggccgggggggtcctgagctctcctgtgcagctctgctacttctacttataacttattatagagcgtcggtccgcgacgccgtcggagggacggggcggtggtaggtgggtcggcgacgactaactaacgaagagtaggtaacgtaagtaaataatatagtagtacgtgtgtaggacggacgacgtcgcactctacgagacgacgaacgaccgaacgaactactacgtacgtcgcgtacgacacgacgtacggaaccggaccggacgaggacggacggacggacgtacggtacgtcgtcgttaacgttcgttgtcgcgacgaccgaccccgaccgttacggaacgggacgtaacgaggtagggacggtaacgttaacgtaacg

SEQ ID NO: 398077 - DNA, 593 bp, Homo sapiens
  misc_feature: GZ8MTXP01EF9LX.38.4.A04.1.454.CMB.2.raw
  modified_base (281)..(281): a, c, t, g, unknown or other
  modified_base (367)..(367): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctcagagacaacgcaagaactcactgnggctgcacatgaacggcctgagaggcgacgacacggctgtgtactttctgtgcgagacgcccccatggagggctacgaggtggganctacgactttgactacgtcgggggccagggaccctggtcaccgtctcctcacgcctaccaccgaacgggccccagtccggttcccttcccccgtggccctacccctcctaccaagacgccaccgttcgtcgggggacacgcggccggcccgttggggccttggcccgttgggttcgaacggaccgttaacgtccgtaacgtcggagttacgtccgttgtaacgggg

SEQ ID NO: 398078 - DNA, 559 bp, Homo sapiens
  misc_feature: GZ8MTXP01BXH6F.38.4.A04.1.454.CMB.2.raw
  modified_base (389)..(389): a, c, t, g, unknown or other
tcagtcgatcacgtcacgaccggtgctcgatttagagtagtgatcaggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagcaaaaaccagggaaacgcccctaaactcctgatctatggtgcatccattttgctaaagtgggtcccatcaaggttcagcgccagtggatcgtgggaacagaatcagtctacacaatcagcagcctgcagcctaggganatactgactaaacttatttattggtactaactagtactttaataccgttaaccccattaccgttttcggaccgtaaggggtacctaaaggttggaacgttacgtacgaaaacgtaacgtggttacggcttacggaaccactaacttcctgttcttcgttaactttccccg

SEQ ID NO: 398079 - DNA, 574 bp, Homo sapiens
  misc_feature: GZ8MTXP01D9T29.38.4.A04.1.454.CMB.2.raw
  modified_base (294)..(294): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagacaaaaaccagggaaacgcccctaaactcctgatctatggtncatccattttgacaaagtgggtcccatcaagttcagcggcagtggatctgggaacagaattcagtctacacaatcagcagcctgcagcctagggatatactgactaaacttattattggtactacagtacttaaataccgttacccccataaccgttttggacccgtaagggggtaccctaaagggttggaagttaacttaccgaaaacgtacgttaggttacgggccttaggaacctaaccctaattcctcgttacctttaaccgttaacgtttccccg

SEQ ID NO: 398080 - DNA, 518 bp, Homo sapiens
  misc_feature: GZ8MTXP01B8COD.38.4.A04.1.454.CMB.2.raw
  modified_base (344)..(344): a, c, t, g, unknown or other
  modified_base (372)..(372): a, c, t, g, unknown or other
  modified_base (391)..(391): a, c, t, g, unknown or other
  modified_base (414)..(414): a, c, t, g, unknown or other
  modified_base (417)..(418): a, c, t, g, unknown or other
  modified_base (432)..(432): a, c, t, g, unknown or other
  modified_base (487)..(487): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcgtgtaggctatttagaaggtgtcagtgtgaggtgcaactggtggagtcgtggggggaggcttggtccaggccgggggggtcctgagactctcctgtgcagcctctgcattcacctttagaactatttaatgagctgggtccgccagcctccgaggggaaggggctggagtgggtgccagcattaaccaagntggaccgtagaaaaatctatgtagactngtgagggccattcgcatcncagagacacgcaagactcactgngcnncacgagagacgcgngagacggacgacgacgcgcgtgtgtctcgttgtgcgacgaccgccccgccgcggnggcgtaacgaggtgggacgtcgttcgtaacg

SEQ ID NO: 398081 - DNA, 557 bp, Homo sapiens
  misc_feature: GZ8MTXP01D7X96.38.4.A04.1.454.CMB.2.raw
  modified_base (284)..(284): a, c, t, g, unknown or other
  modified_base (366)..(366): a, c, t, g, unknown or other
  modified_base (410)..(410): a, c, t, g, unknown or other
  modified_base (538)..(538): a, c, t, g, unknown or other
tcagtcgatcacgtcacgaccggtgctcgatttagagtagtgatcaggggaagaccgatgggcccttggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgnggctgcacatgaacggcctgagaggcgacgacacggctgtgtacttctgtgcgagacgcccccatgagggctacagtggganctacgactttgactacgtggggccagggaccctggtcaccgtcncctcacgcctccaccaacgggcccatccggtccttcccccgtggccaccctcctccaatacgccacctcgtgggggcacgagccggcccttgggccttgcccgtggttcaggactaacttccaacgtnacttcgtaacttggaacgg

SEQ ID NO: 398082 - DNA, 549 bp, Homo sapiens
  misc_feature: GZ8MTXP01C835A.38.4.A04.1.454.CMB.2.raw
  modified_base (256)..(256): a, c, t, g, unknown or other
  modified_base (278)..(278): a, c, t, g, unknown or other
  modified_base (314)..(314): a, c, t, g, unknown or other
  modified_base (387)..(387): a, c, t, g, unknown or other
  modified_base (389)..(389): a, c, t, g, unknown or other
  modified_base (416)..(416): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcggtggtttcgtgtaggctatttagaaggtgtcagtgtgaggtgcaatggtggagtcgtgggggagcttggtccaggccggggggtccctggagctctcctgtgcagctctnctatctacttataatattatgngcgtcggtccgcgacgccgtcgagggagggcgtggnggtgggtcggcgacgactactaacaagagtagtaacgtaagtaaatatatgtagactgtgaggacggcgctcncnctcacagacgacacacaacacacacgngtgcgcgcacgagacgacgacgagagacgacgacgacgtcgtcgtcgtgtcgtcgttgtcgacggaccgacccgacccgccggacggaacggacgtaacggagggtacgggttacggtaacgttaacgtaacg

SEQ ID NO: 398083 - DNA, 544 bp, Homo sapiens
  misc_feature: GZ8MTXP01DEXXE.38.4.A04.1.454.CMB.2.raw
  modified_base (497)..(497): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggccggggggtccctgagactctcctgtgcagcctctgcattcaccttagtaactatttaatgagctgggtccgccagccctccgaggggaggggctggaggtgggtggccagcattaaaccaagatggacgtagaaaatactatgtgctcgtgtaggaagggcccgtagttcgcctatcctaccaagacgaacaacgacctaaagaactcactgtggctgcacagtcgaacggcctggagaggacgacgacacggctggtgtcttcgtgngcgagaccgcccccagtggaggcctagaggttggaacgttcgtaacg

SEQ ID NO: 398084 - DNA, 559 bp, Homo sapiens
  misc_feature: GZ8MTXP01E5CGY.38.4.A04.1.454.CMB.2.raw
  modified_base (279)..(279): a, c, t, g, unknown or other
  modified_base (363)..(363): a, c, t, g, unknown or other
  modified_base (537)..(537): a, c, t, g, unknown or other
tcagtcgatcacgtcacgaccggtgctcgatttagagtagtgatcaggggaagaccgatgggcccttggggaggcttggtccagccgggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccgattcgccatctccagagacaacgccaagactcactgnggctgcacatgaacggcctgagaggcgacgacacggctgtgtacttctgtgcgagacgcccccatggaggctacaggtgggacnctacgactttgactacgtgggggccacgggaaccctgtccaccgtctcctcacgccctccaccgaacgggccccatccggtccttccccgtcggccacccctccaccaagacgccacctcgtgggggcacgcggccggcccgttgggcttcgccgttggcgaggactaactccncgtgcttcgaacgttgaacggg

SEQ ID NO: 398085 - DNA, 548 bp, Homo sapiens
  misc_feature: GZ8MTXP01E0DK4.38.4.A04.1.454.CMB.2.raw
  modified_base (355)..(355): a, c, t, g, unknown or other
  modified_base (362)..(362): a, c, t, g, unknown or other
  modified_base (415)..(415): a, c, t, g, unknown or other
  modified_base (418)..(418): a, c, t, g, unknown or other
tcagtcgatcacgtcacgaccggtgctcgatttagagtagtgatcaggggtctcagagaggagccttagccctggactccaaggcctttccacttggtgatcagcactgagcacagaggactcaccatggaattggggctgagcgtggtttcgtgttaggctatttagaaggtgtccagtgtgaggtgcaactggtggagtctgggggaggcttggtccaggccggggggtccctgagactctcctgtgcagcctctgcattcacctttagaactattaatgagctggtccgccagcctccagggaaggggctggagtgggtggccagcattaacagatggacctgaaaatctangtgactntgtgaaggggccattcgccatctccagagacaacgccaaagaacttcacttgngcngcacgagtagacgacgagaggacggacgacgacgtcgcgtcgtgtcttcgttgtcggcgacggacccgaccccgccgttacggaacgggacgtaacggtagggtacgggacggtaacgttaacgttaacg

SEQ ID NO: 398086 - DNA, 603 bp, Homo sapiens
  misc_feature: GZ8MTXP01DFHI6.38.4.A04.1.454.CMB.2.raw
  modified_base (283)..(283): a, c, t, g, unknown or other
  modified_base (331)..(331): a, c, t, g, unknown or other
  modified_base (366)..(366): a, c, t, g, unknown or other
  modified_base (384)..(384): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgnggctgcacatgaacggcctgagaggcacgacacggctgtgtactttcngtgcgagcgcccccatggagggctacaggtggganctacgactttgactacgngggggccagggacctgtcaccgtctcctcacgcctccaccgaacggcccagtccggtccttcccccgtcggcccacccctcctccaacgacgcctaacccgtcgtcgggggccaccgacggcccgggcccgttggggccttcggcccgtcgggttaccgaacgggacccttaaccgtttacccgaacggttcgacgttccggtaacgttcggaacgggg

SEQ ID NO: 398087 - DNA, 546 bp, Homo sapiens
  misc_feature: GZ8MTXP01B03BU.38.4.A04.1.454.CMB.2.raw
  modified_base (299)..(299): a, c, t, g, unknown or other
  modified_base (379)..(379): a, c, t, g, unknown or other
  modified_base (504)..(504): a, c, t, g, unknown or other
  modified_base (523)..(523): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactatttaatgagctgggtccnccagcctccgaggggaaggggctggagtgggtggccagcattaaccaagatggaaccgtagaaaaatctatgtaggactngtgaagggcgattcgcatctccagagacaacgcaaagactcactgtggctgcacagtgaacgggcctaggagagggacgacgcgaccgggctggtgtaactttcttggtgcgagacgccccccgnttcggaaggggctaaccgnggtgggacgtcgttaacgtaacg

SEQ ID NO: 398088 - DNA, 638 bp, Homo sapiens
  misc_feature: GZ8MTXP01ES79D.38.4.A04.1.454.CMB.2.raw
  modified_base (284)..(284): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggccattcgccatctccagagacaacgccaagaactcactgnggctgcacatgaacggcctgagaggcgacgacacgggctgtgtactttctggtgcgagacccgccccccgacgtagaggacgtacgaaggtagggcgacgtacgtacgtttacgtacgtacggtacggggaccggacgggaacccgtacggtaccgtaccgtcctccctaccacgaccctacccaacccgaaccggacccgtaccgtccgttcccggttccccgtccgtccctacccctaccctacccaacgacgaccacccgtccggtacggggaccgaccgaacggccggcccggtcgggcgtcgtccgttcggttcgacggtaactactaaccgtacgtcgacgtcgcgtg

SEQ ID NO: 398089 - DNA, 529 bp, Homo sapiens
  misc_feature: GZ8MTXP01EGYX9.38.4.A04.1.454.CMB.2.raw
  modified_base (471)..(471): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggccgggggggtccctgagactctcctgtgcagcctctgcattcacctttagaactattaatgagctgggtccgccagcctccgagggaaggggctggagtgggtgccagcattaaccaagatggacctagaaaaatctatgtaggactcgtgtgaagggccattcgccatctcagagacaacgccaaagaactcactgtgctgcacatgaacggcctgagaggcgacgactacggctgtgtaacttcnggtgcgagcggcccccagttggaaggggctaacgaggtgggagtcttaacggttaacg

SEQ ID NO: 398090 - DNA, 593 bp, Homo sapiens
  misc_feature: GZ8MTXP01D17W5.38.4.A04.1.454.CMB.2.raw
  modified_base (272)..(272): a, c, t, g, unknown or other
  modified_base (294)..(294): a, c, t, g, unknown or other
  modified_base (403)..(403): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccggccagtcagggcagttaggacttcgttagcctggtatcagacaaaaaccgagggaaacncccctaactctgatctatggtncatcctattttgactaaaggtcgggtacccatcgaaggttcaggcggccaggtggatcgtagggaacagtaatcagtctacacaatcagcagcctgcagccgtaggganatactgactaaatttattattggtactactagtacttaaactaccgttaacccctagttaccgttttcggacccgtaagggggtaaccctaagggtttaaggaacgttacgtaacgaaaacggtaacgttggttacgggttcttacggaacctacctaattccgtgttccttaacgttaacgtttccccg

SEQ ID NO: 398091 - DNA, 594 bp, Homo sapiens
  misc_feature: GZ8MTXP01B7EOS.38.4.A04.1.454.CMB.2.raw
  modified_base (282)..(282): a, c, t, g, unknown or other
  modified_base (359)..(359): a, c, t, g, unknown or other
  modified_base (367)..(367): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccattcgccatctccagagacaacgcaagaactcactgnggctgcacatgaacggcctgagaggcgacgacacggctgtgtactttctgtgcgagcgcccccagtggagggctacnggtggganctacgctttgactacgtgggggccagggaccctggtcacgtctcctcacgcctccaccgaacggcccactccggtccttccccgtcggccaccctcctccaacgacgccacctcgtcgggggcacgcggccggcccgttggggccttcggtcccgtcgggttaccgaacgggttaccttaaccgtttcccgaacggttcggacgttccggtaacgttcgggaacggg

SEQ ID NO: 398092 - DNA, 560 bp, Homo sapiens
  misc_feature: GZ8MTXP01BVOMD.38.4.A04.1.454.CMB.2.raw
  modified_base (280)..(280): a, c, t, g, unknown or other
  modified_base (329)..(329): a, c, t, g, unknown or other
  modified_base (364)..(364): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctcagagacaacgcaagaactcactgnggctgcacatgaacggcctgagaggcgacgacacggctgtgtactttcngtgcgagacgcccccatggagggctacagtggganctacgctttgactacgtggggccagggaccctgtcaccgtctcctcacgcctccaccgaacgggcccatcggtccttccccgtcggccacccctcctccaacgacgccacctcgtgggggcacgcgccggcccgttgggccttgcccgtggttccgaagggcctaacttccaacgtgacttcgaacgttgaacggg

SEQ ID NO: 398093 - DNA, 715 bp, Homo sapiens
  misc_feature: GZ8MTXP01DPPS3.38.4.A04.1.454.CMB.2.raw
  modified_base (262)..(262): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccagggaaggggctggagtgggtggccagcattaaaccaagatggacgtagaaaaatctatgtggactctgtgaaggcattcgccatctcaganacaacgcaaagaactcactgtggctgcacatgaacggctgagaggcgacgacacggctgtgtactttctgtgcgagaccgcccccagtggagggctacgaggtacgggacgtccttaacgtacttttacggaccgtttacggtacgggggacccgaaacggggtaaaccccgtcgggtacccgtaacccggttccctccccttaccgaacccggtcccctaaccccgaaccccggaaaccggggccccctaacgttcccgggttcccctttccccccgggtcgggtacccctaccccgttcccctaccgaaaccgacgccaacccgtccggtcgggggccaccgacggcccgggtcccgttggggccgttcggcccgttacgggttccgaaacgggaccctttaaccgttacccgtaacggtacgtacgttccggtaacgttcgggaacgggg

SEQ ID NO: 398094 - DNA, 533 bp, Homo sapiens
  misc_feature: GZ8MTXP01BB23P.38.4.A04.1.454.CMB.2.raw
  modified_base (366)..(366): a, c, t, g, unknown or other
  modified_base (394)..(394): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagacaaaaaccagggaaacgcccctaactcctgatctatggtgcatccattttgacaaagtcgggtccatcaaggttcagcggcagtggatcgtgggaacagaattcagtctacanaatcagcagcctgcagcctggagatacngactaacttattattcggtacttacagtacttaataccgttaccccatacgtttcggccgtaggggacctaaggttggaagttatacgaaacgtaactggttcgcttacggctacgaatctgttccttcgaacgttccc

SEQ ID NO: 398095 - DNA, 529 bp, Homo sapiens
  misc_feature: GZ8MTXP01D7WKB.38.4.A04.1.454.CMB.2.raw
  modified_base (445)..(445): a, c, t, g, unknown or other
  modified_base (489)..(489): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccagccggggggtccctgagactctcctgtgcagcctctgcattcacctttagaactatttaatgagctgggtccgccagcctccgagggaggggctggagtgggtgccagcattaaccaagatggacctagaaaaatctatgtaggactctgtgaagggccattcgcatctccagagacaacgaccaaagaactcactgtggctgcacgatgaaacggcctgagnggcgacgacacgactgtgtaacttcttgtgcgagacgcccccgnttcggaagggctaacgaggtgggacgtcgttaacgtaacg

SEQ ID NO: 398096 - DNA, 563 bp, Homo sapiens
  misc_feature: GZ8MTXP01AEIYT.38.4.A04.1.454.CMB.2.raw
  modified_base (284)..(284): a, c, t, g, unknown or other
  modified_base (369)..(369): a, c, t, g, unknown or other
  modified_base (538)..(538): a, c, t, g, unknown or other
  modified_base (542)..(542): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgnggctgcacatgaacggcctgagaggcgacgacacggctgtgtacttctgtgcgagacgccccccatggagggctacaggtggganctacgactttgactacgtggggccaagggaccctggtccaccgtctcctcacgcctccaccgaagggccccatccggtccttccccgtggcccaccctccctccaacgacgcacctcgtcgggggcacgcggcgccgttggggcttgccgtggcgaggactaacttccncgtnacgttcgaacgttggaacggg

SEQ ID NO: 398097 - DNA, 644 bp, Homo sapiens
  misc_feature: GZ8MTXP01A20FL.38.4.A04.1.454.CMB.2.raw
  modified_base (258)..(258): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttcctgttgctatttagaaggtgtcagtgtgaggtgcaactggtggagtcgtgggggaggcttggtccgaggccggggggtccctggagactctcctgtgcagcctcngcattcacctttagaactatttaatggagctgggtccgccagccctccgaggggaaggggctggagtgggtggccagcattaaccaagatggaaccgtagaaaaatctaatgtagggactcgtgtagggaaaggggccaagttcgccaatccttccaaggagaccaacgacaaacgaactcaactgtacgggctagaccacgtaacgtaggaaaccgggccctaggaacggacggggaccggaaaccgaccgaaccggggcgtttacggtggttaaacctttccgttgggttcggccggtaaacggaacccggcccccccgagttacgggaacgggggtaccttaaccggagggttcgggggaacgtccgttaaccggttaaccgg

SEQ ID NO: 398098 - DNA, 572 bp, Homo sapiens
  misc_feature: GZ8MTXP01CCKDM.38.4.A04.1.454.CMB.2.raw
  modified_base (278)..(278): a, c, t, g, unknown or other
  modified_base (283)..(283): a, c, t, g, unknown or other
  modified_base (332)..(332): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccattcgccatctccagagacaacgcaagaactnactgnggctgcacatgaacggcctgagaggcgacgacacggctgtgtactttcngtgcgagacgcccccatggagggctacgaggtggganctaacgactttgacctacgtgggggccagggaccctggtcaccgtctcctcacgcctccaccgacggccatccggtccttccccgtggcccaccctcctaccaacgacgctaccctcgtcgggggcacgcggccggcccgttggccttgccgtggttcgaaggacctaacttccaacgttgacgttcgaaccgttggaacggg

SEQ ID NO: 398099 - DNA, 568 bp, Homo sapiens
  misc_feature: GZ8MTXP01D2IEJ.38.4.A04.1.454.CMB.2.raw
  modified_base (285)..(285): a, c, t, g, unknown or other
  modified_base (333)..(333): a, c, t, g, unknown or other
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgngctgcaacatgaacggctgagaggcgacgacacggctgtgtactttcngtgcgagcgcccccagtggagggctacgaggtggganctacgactttgactacgtgggggaccagggaccctgtccaccgtctcctcacgccctccaccacgggcccatccggtcccttccccgtcggcctacccctccctaccaacgacgccacctcgtcgggggcacgcgccggcccgttcgggcttcgccgtggttcgaggactaacttcaacgtgattcgtaacgttgcgg

SEQ ID NO: 398100 - DNA, 525 bp, Homo sapiens
  misc_feature: GZ8MTXP01DAYKQ.38.4.A04.1.454.CMB.2.raw
  modified_base (301)..(301): a, c, t, g, unknown or other
  modified_base (437)..(437): a, c, t, g, unknown or other
  modified_base (471)..(471): a, c, t, g, unknown or other
  modified_base (479)..(479): a, c, t, g, unknown or other
  modified_base (486)..(486): a, c, t, g, unknown or other
  modified_base (509)..(509): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggccgggggggtccctgagactctcctgtgcagcctctgcattcaccttagtaactatttaatgagctgggtccnccagcctccgaggggaggggctggagtgggtggccagcattaaccagatggacgtagaaaatactatagtggaactcgtgtgaaggggccattcgccatctccagagacaacgccaagaactcactgtggctgcanatgaacggcctgagaggacgacgacacggctgtntacttcgngttgcgngacgccccatggacgggctacgnggttgggcgcgtaacg

SEQ ID NO: 398101 - DNA, 558 bp, Homo sapiens
  misc_feature: GZ8MTXP01DIEBF.38.4.A04.1.454.CMB.2.raw
  modified_base (333)..(333): a, c, t, g, unknown or other
  modified_base (370)..(370): a, c, t, g, unknown or other
  modified_base (389)..(389): a, c, t, g, unknown or other
  modified_base (519)..(519): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaaacgccaagaactcactgtggctgcaacatgaacggcctgagaggcgacgacacggctgtgtactttcngtgcgagagccccccactggagggctacaggtggganctacgactttggactacgnggggcccagggaaccctggtcaccgtctcctcagcctccaccaacgggcccatcggtccttcccccgtcggccacccctcctccaacgacgccaaccctcgtgggggccacaggccggccccttggggcngcctggttcaaggactctccaacgtgattcgtcttgcgg

SEQ ID NO: 398102 - DNA, 747 bp, Homo sapiens
  misc_feature: GZ8MTXP01D4ORK.38.4.A04.1.454.CMB.2.raw
  modified_base (273)..(273): a, c, t, g, unknown or other
  modified_base (302)..(302): a, c, t, g, unknown or other
  modified_base (315)..(315): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttcctgttgctattttagaaggtgtccagttgtgaggtgcaacgtggtggagtcggtgggggaggtcgttggtccgacgggtcccggggggtcctggagtactctccgtgtgcacgcctntcgctatcctaccttagtaactatttaangagcgtgggtccncagcctcgaggggagggctggaggtgggtcgacagctaacttaaaccgaagagtagggaacgtaagaaaaaactactagtaggtaggtaactcgttaggttagggaaacggggccgtaacgtttccggacctaattcccgtaccgaaggaacgtaaaccgaaaccgggaacccaaaaggtaaaccttaccgaaccgttagtcggggtacttacgggacaaaccggtaagttaaccgggaaaccgggacccgttaggaacgggaacgggtaccggaaaccggtaaccgaaccgggtccgttgggttaacgtttaacccgttggtttcgttacgggaccggaacgaaccccggttcccccccgaaaaggttcgggggaacgggtcccgttaaaacgggggtcggggttacggggtaaccgttccggttaaccgg

SEQ ID NO: 398103 - DNA, 594 bp, Homo sapiens
  misc_feature: GZ8MTXP01BWTV0.38.4.A04.1.454.CMB.2.raw
  modified_base (395)..(395): a, c, t, g, unknown or other
tcagtcgatcacgtcacgaccggtgctcgatttagagtagtgatcaggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccggccagtcagggcattaggactcgtttagcctggtatcagacaaaaccagggaaacgcccctaacctcctgatctatggtgcatcctattttgctaaagtggggtcccatcaaggttcagcggccagtggatcgtgggaacagaattcagtctcacaatcagcagcctgcagcctaggagatacngctaaacttattattggtctactagtactttaatacgttacccccataccgttttcgggacccgtaagggggtaaccctaaagggtttcgggaagttaacgttaccgaaaaccgtaaacgttcggttacgggttccttacggaaccctaaccccgtaagtttcccttaggtttccctttaacgttaacgttttcccccg

SEQ ID NO: 398104 - DNA, 706 bp, Homo sapiens
  misc_feature: GZ8MTXP01A8IZX.38.4.A04.1.454.CMB.2.raw
  modified_base (237)..(237): a, c, t, g, unknown or other
  modified_base (259)..(259): a, c, t, g, unknown or other
  modified_base (285)..(285): a, c, t, g, unknown or other
  modified_base (292)..(292): a, c, t, g, unknown or other
  modified_base (301)..(301): a, c, t, g, unknown or other
  modified_base (305)..(305): a, c, t, g, unknown or other
  modified_base (319)..(319): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgagggaagggctggagtgggtggccagcaattaaccaagatggaacgtagaaaaatactatgtggactntgtgaagggccattcgccatcncagagacaacgccaagaactcactgngctgcanatgaacgcngagnggcgacgacacggntgtgtacttcgtgtgcgagaccgcccccagtggaggctacgaggtagggacnctaacgtcgtttgaaccttacgggtcgggggaccaacggggtaacccgttcggtaccctacccggttcctcccgtaccgaaccggcccctacccgaaacccgaaccggggacccctacgttccccgggttccccgtttcccccggtcggtacccctacccccttaccccgtacccgaaaccggaccgacccgtaacccgtccgggtacgggggacccaaccggccgggtcccggccccggttcggggcccgttcggacccggttcgggttacccgaaacggttacccttaaccgtacccgtaacgtcggtacttaccggaacgttgggaaccggg

SEQ ID NO: 398105 - DNA, 674 bp, Homo sapiens
  misc_feature: GZ8MTXP01CHNS3.38.4.A04.1.454.CMB.2.raw
  modified_base (205)..(205): a, c, t, g, unknown or other
  modified_base (237)..(237): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagcgtgggtttcctgttagctattttagaaggtgtcagtgtgaggtgcaactggtggagtntgggggagcttggtccaggccgggggggtccngagctctctgtgacagctctgctatactactaacgtaaactaattaatagagcgtcggtccgaccgacgaccgtaccgaagggaagggacgtaggaggtagggtcggaccgacgacaactaaacgaaagaagtacggaagtaaagtaaaaataaactaagtaagtaggtaacgtacgtaggtagggaacgggacgtacgtacgacctactactacgaacgaacgaacgaaccgaaccgaaacgaactacgtacgtagtacggtacgtacgacgaacgtaacgtacggaacggaccgtacggacggaacggaccggaaccggtaaccgaccggtacgtcggtaacgttacgttacgttcgttacggacgacggaccgaccccgaccgtaacggacgggtaacgtacggtacgggttacgggtaacggttaacgtaacg

SEQ ID NO: 398106 - DNA, 522 bp, Homo sapiens
  misc_feature: GZ8MTXP01A48HB.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactatttaatgagctgggtccgccagcctccgagggaaggggctggagtgggttgccagcattaaccaagatggaccgtagaaaaatctatgtaggactctgtgaagggcgattcgcatctcagagacaacgcaaagactcactgtgctgcacatgaacggctgagaggcgacgacacggctgtgtaactcttgtgcgagcgccccattggaagggctaacgaggtcgggatcgttaacgtaacg

SEQ ID NO: 398107 - DNA, 530 bp, Homo sapiens
  misc_feature: GZ8MTXP01BVIDM.38.4.A04.1.454.CMB.2.raw
  modified_base (297)..(297): a, c, t, g, unknown or other
  modified_base (331)..(331): a, c, t, g, unknown or other
  modified_base (421)..(421): a, c, t, g, unknown or other
  modified_base (517)..(517): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcttggtccaggccggggggtccctgagactctcctgtgcagcctctgcattcacctttagaactatttaatgagctgggtccnccagcctccgaggggaaggggctggagtgggttncccagcattaaccaagatggacgtagaaaaatctatgtaggactgtgtagaagggccattcgcatctcagagacaacgcaaagactcacngtgctgcacatggaacgtctgagaggcgacgacacgggctgtgtaacttcttggtcgcgagaccgcccccgattggaagggctaacgaggtgggancgttaacgtaacg

SEQ ID NO: 398108 - DNA, 530 bp, Homo sapiens
  misc_feature: GZ8MTXP01D69N9.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttccttgttgctatttagaaggtgtccagtgtgaggtgcaactggtggagtctgggggaggcttggtccaggccgggggggtccctgagactctcctgtgcagcctctgcattcacctttagtaactattaatgagctgggtccgccagcctcgagggaaggggctggagtgggtgccagcattaaccagatggaccgtagaaaaatctatgtaggactctggtgaaaggggccagttcgccatctccagagacaacgacaaagaactcactgtgctgcacatgaacgctagagaggcgacgcacgggctgtgtaacttcgttgtcgcgagaccgcccccagttcggaagggccaagaggtgggagtcttaacgttaacg

SEQ ID NO: 398109 - DNA, 523 bp, Homo sapiens
  misc_feature: GZ8MTXP01ELP8K.38.4.A04.1.454.CMB.2.raw
  modified_base (474)..(474): a, c, t, g, unknown or other
  modified_base (504)..(504): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcttggtccagccggggggtccctgagactctcctgtgcagcctctgcattcacctttagaactatttaatgagctgggtccgccagcctccgagggaaggggctggagtgggtggccagcattaaccaagatggaccgtagaaaaaatactatgtaggactctgtgaagggccgattcgccatctcagagacaacgcaaagaactcactgtgctgcacatgaaacggcctgagaggcgaacgacacgggctgtgtaacttcngtgcgagcgcccccattgaagggctaacgngtgggatcgttaacgtaac

SEQ ID NO: 398110 - DNA, 579 bp, Homo sapiens
  misc_feature: GZ8MTXP01DE8UN.38.4.A04.1.454.CMB.2.raw
  modified_base (332)..(332): a, c, t, g, unknown or other
  modified_base (366)..(366): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcaccttttagtaactatttaatgagctgggtccgccagcctccagggaaggggctggagtgggtggccagcattaaccaagatggacgtgaaaaaatctatgtggactctgtgaagggccattcgccatctcagagacaaacgccaagaactcactgtggctgcacatgaacggctgagaggcgacgacacggctgtgtactttcngtgcgagcgccccccatgagggctacagtggganctacgactttgactacgtggggccagggaaccctggtcaccgtctcctcagccctccacccgaacgggtcccacgtccggtcccttccccgtcggcccacccctcctccaaacgacgccaccctcgtcgggggaccacgacgccggcccgttggggccttgcccgtgggttccgaggacctaacttccaacgttgattcgaacgttgaacggg

SEQ ID NO: 398111 - DNA, 616 bp, Homo sapiens
  misc_feature: GZ8MTXP01B9E4N.38.4.A04.1.454.CMB.2.raw
  modified_base (286)..(286): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaaatactatgtggactctgtgaagggccgattcgccatctcagagacaacgcaagaactcactgngctgcacatgaacggctgagaggcgacgacacggctgtgtacttctgtgcgagacgccccccagtggagggctacgaggtgggancgtacgtactttcgaactacggtcgggggccaacgggaccctggtccaccgtctcctcacgccctccaccgaacgggcccactccggtcccttccccgtcggcctacccctccctaccaacgacgccacccgtcgtcgggggccaccgcggcccgggcccgttcggggtccttcggtcccgtcgggttaccgaacgggaccttaaccgttcccgaacgttcgacgttcgaaccgttggaacgggg

SEQ ID NO: 398112 - DNA, 711 bp, Homo sapiens
  misc_feature: GZ8MTXP01DNL6H.38.4.A04.1.454.CMB.2.raw
  modified_base (335)..(335): a, c, t, g, unknown or other
  modified_base (364)..(364): a, c, t, g, unknown or other
  modified_base (373)..(373): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgaggggaagggctggagtgggtggccagcaattaaccaagatggacgtagaaaaaatctatgtggactctgtgaagggccattcgccatctcagagacaacgcaagaactcactgtggctgcacatgaacggcctgagaggcgaacgacacggctgtgtacttcngtgcgagacgcccccatggagggctaacnggtagggancgtacgtacttttagactacggtcgggggaccctaacgggaaacccgtcggttaccacccggtccttccctaccgaccgtcccctacccaacccggaaaccgggcccctaacgttcccggttccccgttccccccgtcgggacccctaaccccctcccctaacccgaaacggaccggaccctaaccccgttccgggtccggggggacccaaccggaaccgggtccccggggccccggttcgggggcccttacggccccgttcgggttaaccgaaacgggttaaccctttaaccgtacccgtaacggttcgaacgttccggaaccgttgggaaccgggg

SEQ ID NO: 398113 - DNA, 552 bp, Homo sapiens
  misc_feature: GZ8MTXP01EN373.38.4.A04.1.454.CMB.2.raw
  modified_base (372)..(372): a, c, t, g, unknown or other
  modified_base (476)..(476): a, c, t, g, unknown or other
  modified_base (494)..(494): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagaggcgacgacacggctgtgtactttctgtgcgagacgccccccactggagggctacagtggganctacgactttgactacgtgggggccagggaccctggtcaccgtctcctcacgcctccaccaagggcccatcggtccttcccccgtggccaccctcctccaacgngcacctctgggggcacgngcggcccttgggcttgcctgttcgaggctaacttcaacgtgattcgaacgttgaacgg

SEQ ID NO: 398114 - DNA, 615 bp, Homo sapiens
  misc_feature: GZ8MTXP01ADMNZ.38.4.A04.1.454.CMB.2.raw
  modified_base (268)..(268): a, c, t, g, unknown or other
  modified_base (291)..(291): a, c, t, g, unknown or other
  modified_base (411)..(411): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccggcagtcagggcattaggactcgttagcctggtatcagacaaaaaccgagggaacncccctaactcctgatctatggtncatcctattttgacaaaggtcgggtacccatcgtaaaggttcagcggcaggtggatcgtagggaaacagtaacttcagtctacacaatcagcagcctgccagccgtaggatactacgtanaccttaaattatttattcggtactaacgtagttaacctttaaacttacccgttacccccaagtttaaccggttttcggacccggtaaacgggtaaccctaagggtttaacgggaaattaacgttaacgaaaacggttacgtgggttcggcttacggaaccctaacccgttcttccgttacgttaccttaaccgttccgttcccg

SEQ ID NO: 398115 - DNA, 588 bp, Homo sapiens
  misc_feature: GZ8MTXP01A2O01.38.4.A04.1.454.CMB.2.raw
  modified_base (282)..(282): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagactcactgnggctgcacatgaacggctgagaggcgacgacacggctgtgtactttctgtgcgagacgcccccatggagggctacagtgggagctacgactttgacgtaccggggcaggggaaccctggtcaccgtctcctcacgcctcaccaagggcccatcggtcttcccccgtcggggccaccctcctccaacgacgccaccctcgtcgggggccaacgcggccggcccctgggggcctcggcccgtgggtacaaacgggttccttaacgtttccccacggttcgaactccggacgtcggaagggtcccgggg

SEQ ID NO: 398116 - DNA, 539 bp, Homo sapiens
  misc_feature: GZ8MTXP01D8RGK.38.4.A04.1.454.CMB.2.raw
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcacatcacttgccggccagtcagggcagttaggacttcgttagcctggtatcaagacaaaaacagggaaacgcccctaaactcctgatctagtggtgctatcctattttgactaaaggtcgggtacccatcgaagttcagcggcaggtgatcgtagggaacagtaattcagtctacaacaatcagcagctgcagcctagggagtatactagactaacttatttagttggtctaactagtacttaatacgttacccctatacgtttcgccgtaacgggactaagtaaggattactacaaacgaatgttagcttagccactaatctagttcttcaacgttccc

SEQ ID NO: 398117 - DNA, 559 bp, Homo sapiens
  misc_feature: GZ8MTXP01ASKWI.38.4.A04.1.454.CMB.2.raw
  modified_base (294)..(294): a, c, t, g, unknown or other
  modified_base (373)..(373): a, c, t, g, unknown or other
  modified_base (420)..(420): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcttggtccaggccggggggtccctgagactctcctgtgcagcctctgcattcacctttagaactattaatgagctgggtccnccagccctccgagggaaggggctggagtgggtgccagcattaaccaagatggaccgtagaaaaatctatgtaggactcngtgaagggccgattcgcatctcagagacaacgaccaagactcactgnggactgcacgagtacggaacggccgtagagacggcgaacgacgaccggctgtcgtaacttcgttgtcgcggacgaccgcccccgcgttacgggaacgggtcgtaaccgagggtcggggagtccgttaacgggttaaccg

SEQ ID NO: 398118 - DNA, 612 bp, Homo sapiens
  misc_feature: GZ8MTXP01AWJH2.38.4.A04.1.454.CMB.2.raw
  modified_base (279)..(279): a, c, t, g, unknown or other
  modified_base (284)..(284): a, c, t, g, unknown or other
  modified_base (332)..(332): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccagggaaggggctggagtgggtggccagcattaaccaagatggacgtagaaaaatactatgtggactctgtgaagggccattcgccatctcagagacaacgccaagactnactgngctgcacatgaacggcctgagaggcgacgacacggctgtgtacttcgngtgcgagacgcccccagtggagggctacgaggtgggganctacgtactttgactacgcgggggacccaagggaacccgtggtccaccgtctcctcacgccctaccacccgaacgggcccacgtccggttcccttcccccggtcggcccacccctccctaccaacgcgccaccgtcgtcgggggcacgcgccggcccgttcggggcttcggccgtgggttaccgaacgggacccttaaccgttcccgaacggttcgacgttccggaaccgttaaggccggg

SEQ ID NO: 398119 - DNA, 595 bp, Homo sapiens
  misc_feature: GZ8MTXP01CUOWO.38.4.A04.1.454.CMB.2.raw
  modified_base (228)..(228): a, c, t, g, unknown or other
  modified_base (252)..(252): a, c, t, g, unknown or other
  modified_base (270)..(270): a, c, t, g, unknown or other
  modified_base (290)..(290): a, c, t, g, unknown or other
  modified_base (354)..(354): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgcagcctcgagggagggctggagtgggtgcagcattaacaagatggactagaaaaatctatgtgactntgtgaaggcattcgcatctcaganacacgcaagactcactgngctgcacatgaacgctgagnggcgacgacgacgctgtgtacttcgtgtgcgagaccgcccccagtggaggctacgaggtgggancgtaacgtactttagactacggtcggggaccgaacgggtaacccgtggtaccgtaccgttctccctacgacgtccctaccaaccgaacggcccacgtccgtcccttccccggtcggccctaccctcctaccaacgcgccacccgttcggtcgggggacacgcggccggccgttcgggcttcgccgtggttaccgacggttaccttaacgttccgaacgtcgacgacgtggaacggtccggg

SEQ ID NO: 398120 - DNA, 515 bp, Homo sapiens
  misc_feature: GZ8MTXP01D791F.38.4.A04.1.454.CMB.2.raw
  modified_base (251)..(251): a, c, t, g, unknown or other
  modified_base (276)..(276): a, c, t, g, unknown or other
  modified_base (288)..(288): a, c, t, g, unknown or other
  modified_base (388)..(388): a, c, t, g, unknown or other
  modified_base (460)..(460): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattgggctgagctgggtttcctgtgctatttagaaggtgtcagtgtgaggtgcaactggtggagtctgggggagcttggtccaggccggggggtccctgagactctcctgtgcagcctntgcattcacctttagaactattaangagctgggtccncagcctccgagggaagggctggagtgggtgccagcattaaccaagatggactagaaaatctatgtagactcgtgtgaaagggccgattcgcatctcaganacaacgcaaagactcactgtgctgcacgagtgaacggcctgagaggcgacgacacgggctgtgtaacttcgngtgcgagacgccccattggaacgggctaacgaggtgggatccgttaacggtaacg

SEQ ID NO: 398121 - DNA, 530 bp, Homo sapiens
  misc_feature: GZ8MTXP01AUG70.38.4.A04.1.454.CMB.2.raw
  modified_base (469)..(469): a, c, t, g, unknown or other
  modified_base (508)..(508): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcttggtccagccggggggtccctgagactctcctgtgcagcctctgcattcacctttagaactatttaatgagctgggtccgccagcctccgagggaaggggctggagtggggtgcagcattaaccaagatggaccgtagaaaaatctatgtggactctgtgaagggccgattcgccatctccagagacaacgccaagaactcactgtgctgcacatgaacgcctgagaggcgacgacacgggctgtgtaacttcgngtgcgacgacgccccccgagttcggaaggggcctaacgnggtgggagtcgttaacgtaacg

SEQ ID NO: 398122 - DNA, 531 bp, Homo sapiens
  misc_feature: GZ8MTXP01EJBXD.38.4.A04.1.454.CMB.2.raw
  modified_base (382)..(382): a, c, t, g, unknown or other
  modified_base (390)..(390): a, c, t, g, unknown or other
  modified_base (398)..(398): a, c, t, g, unknown or other
  modified_base (403)..(404): a, c, t, g, unknown or other
  modified_base (406)..(406): a, c, t, g, unknown or other
  modified_base (408)..(409): a, c, t, g, unknown or other
  modified_base (415)..(415): a, c, t, g, unknown or other
  modified_base (425)..(425): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtagctatttagaaggtgtcagtgtgaggtgcaatggtggagtctgggggagcttggtccaggccgggggggtcctgagactctcctgtgcagctctgcatcaccttataatattaattgagcgtggtccggccagcctccgaggaaggggcgtggagtgggttgccagcattaaccaagataggacgtagaaaataataatgtaggactctgtgaggcgattcgcanctcagaanacacacanacacnngngnncacganacgacgacgngagacggacgacgacgacgtacgtcgtgtcgttcgttgtcgacggacgaccgacccgcgttacggaacggtacgtaacgaggagggacggtaacgttaacgtaacg

SEQ ID NO: 398123 - DNA, 808 bp, Homo sapiens
  misc_feature: GZ8MTXP01C9LT5.38.4.A04.1.454.CMB.2.raw
  modified_base (282)..(282): a, c, t, g, unknown or other
  modified_base (329)..(329): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcaccttttagtaactatttaatgagctgggtccgcagcctccgagggaagggctggagtgggtggccagcattaaccaagatggaacgtagaaaaaatctatgtggactctgtgaaggccattcgcatctcagagacaacgcaagactcactgngctgcacatgaacgctgagaggcgacgacacggctgtgtactttcgngtgcgagcgcccccaagtggaacgggctaacgagggtacggggaacgtccgtaaacgtacgttttacggaaccgttaccgggtcggggggacccctaacggggtaaacccccgttcgggtacccgtacccggttcctccccgttaccgaaccggtccccttaccccgaaaccccggaaaccgggggaccccctaaccggtttaccccgggggtttacccccttttcccccccggggttcccggggtaccccctaaacccccccgttaccccttaaccccgtaaaaccggacccggaccctaaaccccggttccggggtaccggggggacccaaaccggaaccggggtccccggggccccggttcgggggtcccgttccgggtcccggttaggggttaacccgttaaacggggttaccctttaacccgttacccgtaaccgggttacgtacgttacccggtaacgttcggggaaccgggg

SEQ ID NO: 398124 - DNA, 607 bp, Homo sapiens
  misc_feature: GZ8MTXP01C46XC.38.4.A04.1.454.CMB.2.raw
  modified_base (268)..(268): a, c, t, g, unknown or other
  modified_base (405)..(405): a, c, t, g, unknown or other
  modified_base (516)..(516): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactgttagcctggtatcagacaaaaaccgagggaaacnccctaacctcctgatctatggtgcatccattttgactaaaggtcgggtccatcaaggttcaggcggccaggtgatcgtagggaacagtaatcagtctacacaatcagcagccgtgacacgaccgtaggagataactnacctaaatttattaattcgggtaacttaacctagtaaccttaaagtaccgttaaccccctaattaccgttttcgggaccgtaaggggtaaccctaaggttaaggggtaaanaacgttaacgaaaacgtaaaccgttggttacgggttcttcggaacctaacctaacgtttccctaaggtttacttccgaacgttttcccccg

SEQ ID NO: 398125 - DNA, 547 bp, Homo sapiens
  misc_feature: GZ8MTXP01EAANU.38.4.A04.1.454.CMB.2.raw
  modified_base (296)..(296): a, c, t, g, unknown or other
  modified_base (504)..(504): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcttggtccaggccggggggtccctgagactctcctgtgcagcctctgcattcacctttagaactattaatgagctgggtccnccagcctccgagggagggctggagtgggtgccagcattaaccaagatggaaccgtagaaaaatctatgtaggactgtgtgaaacgggcctattcgcatctcagagacaacgaccaaagactcactggtgctgcaacgatacggaacgccgtggaggcggccgaacgacacgggtctgtgtaacttcgttgtcgcgaacgcgcccccgngttcggaacgggctaacggaggtgggactccgttaacgtaacg

SEQ ID NO: 398126 - DNA, 628 bp, Homo sapiens
  misc_feature: GZ8MTXP01CA2PF.38.4.A04.1.454.CMB.2.raw
  modified_base (240)..(240): a, c, t, g, unknown or other
  modified_base (288)..(288): a, c, t, g, unknown or other
  modified_base (295)..(295): a, c, t, g, unknown or other
  modified_base (335)..(335): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccaggccggggggtccctgagactctcctgtgcagcctctgcattcaccttttagtaactatttaatgagctgggtccgccagcctccgagggaagggctggagtgggtggccagcaattaaaccaagatggaacgtagaaaaaatctatgtggactntgtgaagggccattcgccatctcagagacaacgccaaagactcactgngctgcanatgaaccggctgagaggcgacgacacggctgtgtacttgngtgcgagacgcccccatggaggctacgaggtggganctacgtactttgactacgtcgggggcaacgggaccctggtccaccgtctcctcgacgccctacaccgaacgggccctagtccggtcccttcccccggtcggtacccaccccttcccaccaaacgaccgccacccgtcgtcgggggccaccgcggcccggcccgttcgggggccttcgggccccgttgggttaccgaaaacgggttcccttaaccgttcccgaacgttggacttaccggtaaccggttcgggaacggg

SEQ ID NO: 398127 - DNA, 578 bp, Homo sapiens
  misc_feature: GZ8MTXP01EV1PM.38.4.A04.1.454.CMB.2.raw
  modified_base (289)..(289): a, c, t, g, unknown or other
  modified_base (335)..(335): a, c, t, g, unknown or other
  modified_base (370)..(370): a, c, t, g, unknown or other
  modified_base (498)..(498): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaaatactatgtggactctgtgaagggccgattcgccatctccagagacaacgccaaagaactcactgngctgcacatgaacggctgagaggcacgacacggctgtgtactttcngtgcgagtcgcccccatggaggctacaggtggganctacgtactttgactacgtggggccaacgggacctgtcaccgtctcctcacgcctaccaccaacggcccacgtcgtcccttccccgtcggtccaccctccctccaacgacgccaccgtcgtcggggcncgacgcggccgttcggcgttcgccgtcgttcgggggaacttacgtaaccttcgaacgttgacgttcgaacgttgaagggg

SEQ ID NO: 398128 - DNA, 535 bp, Homo sapiens
  misc_feature: GZ8MTXP01CXM8N.38.4.A04.1.454.CMB.2.raw
  modified_base (299)..(299): a, c, t, g, unknown or other
  modified_base (399)..(399): a, c, t, g, unknown or other
  modified_base (516)..(516): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttgggtccaggccgggggggtccctgagactctcctgtgcagcctctgcattcaccttagtaactattaatgagctgggtccnccagcctccgaggggaaggggctggagtgggtgccagcattaaccaagatcggacgtagaaaatactatgtagctcgtgtaggaagggccatcgccatcncagagacaacgaccaaagactcactgtgctgcacagtgaacggcctggacgagggaccgacgacgtacggctggtctacttcgtgttgcgacacgcccccactgggacgggctacgnggttcggaagccgttaacg

SEQ ID NO: 398129 - DNA, 579 bp, Homo sapiens
  misc_feature: GZ8MTXP01BVRBB.38.4.A04.1.454.CMB.2.raw
  modified_base (285)..(285): a, c, t, g, unknown or other
  modified_base (331)..(331): a, c, t, g, unknown or other
  modified_base (368)..(368): a, c, t, g, unknown or other
  modified_base (484)..(484): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaaggggctggagtgggtggccagcattaaccaagatggacgtagaaaaatctatgtggactctgtgaagggccgattcgccatctcagagacaacgccaagactcactgnggctgcacatgaacggctgagaggcacgacacggctgtgtactttngtgcgagcgcccccagtggagggctacgaggtggganctacgtctttgactacgtgggggaccacgggaccctggtccaccgtctcctcacgccctaccaccgaacggcccagtccgtcccttccccggtggcccaccccttccaccaacgcncacctcggtcggggcacgcggccggccgttggggccttcgaccgtcggttacgaacggacttaaccttcgaacgtgagttcgaacgttgaacggg

SEQ ID NO: 398130 - DNA, 581 bp, Homo sapiens
  misc_feature: GZ8MTXP01ASPNQ.38.4.A04.1.454.CMB.2.raw
  modified_base (283)..(283): a, c, t, g, unknown or other
  modified_base (462)..(462): a, c, t, g, unknown or other
  modified_base (500)..(500): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgnggctgcacatgaacggcctgagaggcgacgacacggctgtgtacttctgtgcgagcgcccccatgagggctacagtgggagctacgactttgactacgtggggccagggaccctggccaccgtctcctcacgccctccaccgaacgggccccagtccggtcccttcccccgtggacccnccctccctcccaacgacgccacctccgtggggcgaccncgccggcccgttcgggcgttcgtcgtcggttcgacggttaccgtaaccttccgtaaccgtgacgttcgaacgttcgcgggg

SEQ ID NO: 398131 - DNA, 681 bp, Homo sapiens
  misc_feature: GZ8MTXP01CPUUT.38.4.A04.1.454.CMB.2.raw
  modified_base (375)..(375): a, c, t, g, unknown or other
  modified_base (404)..(404): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttctgtctgcatcgtggtaggggacagagtcaccatcacttgccggccagtcagggcagttaggactcgttagcctggtatcaagacaaaaaccgagggaaacgcccctaaactcctagatctatggtgctatcctattttgactaaaggtcgggtccatacaaggttcagcgcagtggatcgtggaaacagtaattcagtctacanaatcagcagcctgacgagccgtagggaanacttacgtagacttaaactttaatttacgttacgggttacttaacgtaaacgttaaccttttaaaacgttaaccccgtttaaaccccccctaacgtttaacccggtttttacggggaccccgtaaacggggggtaaacccttaaaggggtttaagggaaacgttaaacgttaaaccgaaaacccggtaaagttggttaccgggaccttacgggaaccctaaacccgtttaacgtttaccgtttacgtttaccctttaaccgttaacccgtttccccg

SEQ ID NO: 398132 - DNA, 556 bp, Homo sapiens
  misc_feature: GZ8MTXP01DN3Z5.38.4.A04.1.454.CMB.2.raw
  modified_base (431)..(431): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcttggtccaggccgggggggtccctgagactctcctgtgcagcctctgcattcacctttagtaactattaatgagctgggtccgcagcctccgagggaaggggctgggagtggggtgcccagcattaaccaagatggaaccgtagaaaaatctatgtaggactcgtagtggaagggccgtattcgcatctccagagacaacgaccaaagactcactgngctgacacgataggaaccgctagacgaggcgacgacgtacggtctgtgtaacttcttggtcgacggacgccgcccccgagttcggaagggacctaacgaggtcgggacgtccgttaacgtaaccg

SEQ ID NO: 398133 - DNA, 577 bp, Homo sapiens
  misc_feature: GZ8MTXP01EJB2J.38.4.A04.1.454.CMB.2.raw
  modified_base (272)..(272): a, c, t, g, unknown or other
  modified_base (294)..(294): a, c, t, g, unknown or other
  modified_base (406)..(406): a, c, t, g, unknown or other
  modified_base (411)..(411): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggcagtcagggcattaggacttcgtttagcctggtatcagacaaaaaccgagggaaacncccctaactctgatctatggtncatcctattttgactaaaggtcggggtacccagtacaaggttcaggcggcaggtggatcgtagggaaacagtaattcaagtctacaacaatcagcagcctgcagctaggganatacngactaatttattattcggtactactagtactttaaatacccgttaaccccctagttaacgtttcggaccgtaaggggaaccctaagggttaaggaattaactaacgaaaacgtaacgtggttaggcttacggaacacctaattcgttcgttacttcaacgtttccc

SEQ ID NO: 398134 - DNA, 663 bp, Homo sapiens
  misc_feature: GZ8MTXP01EWWI4.38.4.A04.1.454.CMB.2.raw
  modified_base (268)..(268): a, c, t, g, unknown or other
  modified_base (291)..(291): a, c, t, g, unknown or other
  modified_base (298)..(298): a, c, t, g, unknown or other
  modified_base (608)..(608): a, c, t, g, unknown or other
  modified_base (629)..(629): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttctgtctgcatctgtaggggacagagtcaccatcacttgccgggccagtcagggcattaggacttcgtttagcctggtatcagacaaaacagggaaacncccctaactcctgatctatggtncatcctntttgactaaaggtgggtacccatcgaaggttcaggcggcaggtggatcgtggaaacagtaattcagtcctacactaactcgagacgaacgtccctggaccgacggcccgttaggggaactacttaacgtaggtacccttaaactttaactttagtttacgggtctaacgtacgttaacctttaaaaccgtttaaccccggttaaacccccccttagtttaacccgttttaggggaaccccgggtaaacgggggtaacccgttaaagggtttaacgggtaagttaaacttaacgaaaaccggtaaacgttnaaaccgggttcttcggaaccnctaagtccctagtttcctcgttaacgtttccccg

SEQ ID NO: 398135 - DNA, 553 bp, Homo sapiens
  misc_feature: GZ8MTXP01CN9G6.38.4.A04.1.454.CMB.2.raw
  modified_base (294)..(294): a, c, t, g, unknown or other
  modified_base (336)..(336): a, c, t, g, unknown or other
  modified_base (454)..(454): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtggggggaggctttgggtccgagggcccgggggggtccctggagactctcctgtgcagcctctgcattcacctttagaactatttaangagctgggtccgccagcctccgagggaggggctggagtgggngccagcattaaccaagatggaaccgtagaaaaaatctatgtaggactcgtgtaggaaagggccattcgcatctcagagacaacgacaaagactcactgtgctgcacgatgaacgccgngaggacggcgacgacgacggctgtgtaacttcgttggtgcgacgaccgcccccgagttcggaacggggctaacgagggtgggacgtcgttaacgtaacg

SEQ ID NO: 398136 - DNA, 657 bp, Homo sapiens
  misc_feature: GZ8MTXP01DH8XC.38.4.A04.1.454.CMB.2.raw
  modified_base (191)..(191): a, c, t, g, unknown or other
  modified_base (246)..(246): a, c, t, g, unknown or other
  modified_base (266)..(266): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccagatgtgccatccagttgacccagtctccactcctccctgtctgcatctgtagganacagagtcacatcacttgccggcagtcagggcattagctagttattagctggtancagacaaaacgagggaaacncccctaagctacctgatctatcgctcgcctcctacttttgacgtaaacggttcgggggtaccccataccgtaacggttcacggcggacaggtacgggacttcggtaggggaaacctaggttactttacctaaccttcttacccaaccctaattccgaacggccacggtcccttaggaccgaacgtcccgtaggtaaacgttagtttttacgacctttaaacgttttaactttaaccgttgttaacctaaactacgttaacttttaaacgttaagttttactacttccgtacgttttcggggaacggtaagggttacccgtaaaggggttcaaaggtacttaaaccgaaacgttaacgtcggttaggccttcggacttactaacttcgttcc

SEQ ID NO: 398137 - DNA, 537 bp, Homo sapiens
  misc_feature: GZ8MTXP01DZJ6A.38.4.A04.1.454.CMB.2.raw
  modified_base (304)..(304): a, c, t, g, unknown or other
  modified_base (430)..(430): a, c, t, g, unknown or other
  modified_base (477)..(477): a, c, t, g, unknown or other
  modified_base (494)..(494): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccaggcccggggggggtccctggagactctcctgtgcagcctctgcattcacctttagtaactatttaatgagctgggtccnccagcctccgaggggagggctggagtgggtgccagcaattaaccaagatggaaccgtagaaaaatctatgtaggactgtgtagaagggccattcgcatctcagagacaacgccaaagactcactgngctgcagatgaacgctgagaggcgaacgcacggctgtgtaacttcgngtgcgagccgcccccgngttcggaagggcctaagagggtgggacgtcgttaacggtaacg

SEQ ID NO: 398138 - DNA, 561 bp, Homo sapiens
  misc_feature: GZ8MTXP01D4EXG.38.4.A04.1.454.CMB.2.raw
  modified_base (190)..(190): a, c, t, g, unknown or other
  modified_base (261)..(261): a, c, t, g, unknown or other
  modified_base (268)..(268): a, c, t, g, unknown or other
  modified_base (469)..(469): a, c, t, g, unknown or other
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttggcccagtctccatcctcctgtctgcatctgtagganacagagtcaccatcacttgccgggcagtcagggcattagctagttattagcctggtatcagacaaaaacgnggaaacnccctaaagctctgatctatgctgcctctactttgacaaaggtcgggtacccatacgaaggttcaggcggcaggtggaatcgtggggactagtactttcactcacaccatcagcagcctgactagcctaggaatatttcgaactaactttattacgtgtacaaactagtacttaaatagtttactcgtactacgtttcgggnggtaaacgggtaccgaagggttcgaaagaaacgttaacaaaacggttacttgggtcggtacttaacgacctaccttattcctttgttaaccc

SEQ ID NO: 398139 - DNA, 564 bp, Homo sapiens
  misc_feature: GZ8MTXP01CRGJJ.38.4.A04.1.454.CMB.2.raw
  modified_base (281)..(281): a, c, t, g, unknown or other
  modified_base (327)..(327): a, c, t, g, unknown or other
  modified_base (363)..(363): a, c, t, g, unknown or other
  modified_base (382)..(382): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgcaagactcactgngctgcacatgaacggctgagaggcgacgacacggctgtgtacttcngtgcgagcgcccccagttagggctacgagtgggaanctaacgactttgactacgnggggccagggaaccctggtcaccgtctcctcacgccctccaccaacgggcccacgtccggtccttccccctggggccctaccccgtcctccaagacgccaccgtcgtcggggcacgcgccggcccgtgggcctcgccgtgggtcaacggcttacttccgacgtgactcgactggaaggcggg

SEQ ID NO: 398140 - DNA, 534 bp, Homo sapiens
  misc_feature: GZ8MTXP01CRGIW.38.4.A04.1.454.CMB.2.raw
  modified_base (443)..(443): a, c, t, g, unknown or other
  modified_base (448)..(448): a, c, t, g, unknown or other
  modified_base (460)..(460): a, c, t, g, unknown or other
  modified_base (467)..(467): a, c, t, g, unknown or other
  modified_base (497)..(497): a, c, t, g, unknown or other
  modified_base (514)..(514): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcctgttgctattttagaaggtgtccagtgtgaggtgcaactggtggagtcgtgggggaggcttggtccaggccgggggggtccctgagactctcctgtgcagcctctgctattcacctttagtaactatttaatgagcgtgggtccgcagcctccgaggggaaggggctggagtgggtggccagcattaaccagatggaccgtagaaaatctatgtaggactctgtgaagggcatcgcatcacagacgacaacgccaaagactcactggtgctgaccagagtggaacgccnggagngggcgacgaacnccgggtntgtgtaactcgttgcgcgacgccgccccgngttcggaacggctaagnggtgggactcgttaacgtcg

SEQ ID NO: 398141 - DNA, 579 bp, Homo sapiens
  misc_feature: GZ8MTXP01CQ8JF.38.4.A04.1.454.CMB.2.raw
  modified_base (271)..(271): a, c, t, g, unknown or other
  modified_base (295)..(295): a, c, t, g, unknown or other
  modified_base (414)..(414): a, c, t, g, unknown or other
  modified_base (420)..(420): a, c, t, g, unknown or other
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggcagtcagggcagttaggacttcgtttagctggtatcagacaaaacgagggaaacncccctaactcctgatctagtggtnctatcctattttagactaaaggttcgggtacccattacgaaaggttccaaggcggaccaggtggatcgagggaaacagtaacttcagtctacaacatcagcagcctgcagccgtagganactacngactaacttattattcggtactactagtacttaaactaccgttacccctattacgtttcggaccgtaagggtacctaaggttggaacgttaacgttaacgaaacgtaacgtggttacgcttacgaaccactaattcctgttaccttcgttaacttcccg

SEQ ID NO: 398142 - DNA, 660 bp, Homo sapiens
  misc_feature: GZ8MTXP01AD0M6.38.4.A04.1.454.CMB.2.raw
  modified_base (281)..(281): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggaacgtagaaaaaatctatgtgactctgtgaaggcattcgccatctcagagacaacgcaagaactcactgnggctgcacatgaacggcctggagaggcgacgacacggctgtgtacttctggtgcgagcgccccccagtggagggctacgaggtggganctaacgtactttgactacgtggggaccagggaccctggtccaccgtctcctcacgcctaccaccgaacgggccctacgtccggtcccttcccccggtcggtcccctaccccttccctacccgaaacggccgtacccgtacccgttccgggtcggggggaccaccggaccggcccgggtccccggttcgggggcccttcgggcccgttacggggttaccggttaaaacgggttaccctttaacccgttcccgtaacccggttgacgttaccggaaccgttggggaaccgggg

SEQ ID NO: 398143 - DNA, 767 bp, Homo sapiens
  misc_feature: GZ8MTXP01DUKTJ.38.4.A04.1.454.CMB.2.raw
  modified_base (257)..(257): a, c, t, g, unknown or other
  modified_base (296)..(296): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtgggttttccttgttgctatttagaggtgtccagtgtgaggtgcaactggtggagtcgtgggggagcttggtccgaggccggggggtccctgagactctctgtgcagcctntgcattcacctttagaacttattaatgagcgtgggtccncagcctccgagggagggctggagtgggtgccagcaattaaccgaagagtaggaaccgtaagaaaaattactaagtggtaaggactcgtaggtaggaaacggggtcccgtaagtttccgcctaacttcccgtacccgaacggaaacggaaaccaaacccggaacccaaaacggtaaacccttaccgtaaaccgttggttacgggccttacggaccccaaacggtaaacgttaaccgggggtaaacccgggtacccggtagggaaacggggaacggggacccgggaaacccgggaaccggtaaccggggtacccgtttgggttcgggtttaaacccttttccggttaggggttccgggaccgggaaaccggaaccccggccccccccggttaaggttaccggggaacgggggtaccctaaccgggtaaggggttccgggggaacggtaacccgtttaaccgggtttaacccgg

SEQ ID NO: 398144 - DNA, 609 bp, Homo sapiens
  misc_feature: GZ8MTXP01A1PZT.38.4.A04.1.454.CMB.2.raw
  modified_base (284)..(284): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaaggggctggagtgggtggccagcattaaccaagatggacgtagaaaaatctatgtggactctgtgaagggccattcgccatctccagagacaacgcaagactcactgnggctgcacatgaacggcctgagaggcgacgacacggctgtgtacttctgtgcgagacgcccccatggagggctacgaggtgggagcgtacgtactttggacctacggtcgggggccaacggggaaccctggtccaccgtctcctcacgccctccaccgaacgggcccacgtccggtcccttccccggtcggccctaccctccctccaacgcgccaccgtcgtcgggggccacgcggccggcccgttggggccttcggccgtcgggttccgaacgggttaccttaaccgttcccgaacgttcgacgttccgaacgttcggaacggg

SEQ ID NO: 398145 - DNA, 536 bp, Homo sapiens
  misc_feature: GZ8MTXP01EUQBM.38.4.A04.1.454.CMB.2.raw
  modified_base (297)..(297): a, c, t, g, unknown or other
  modified_base (513)..(513): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggagcttggtccaggccgggggggtccctgagactctcctgtgcagcctctgcattcacctttagaactattaatgagctgggtccncagcctcgagggaggggctggagtgggtgccagcattaaccaagatggacctagaaaaatctatgtagactgtgtgaagggccattcgcatctcagagacaacgcaaagaactcactgtcggctgacacgatcggaaccggcctaggagaggcgaacgacgacggctgtgtaacttcgttgtgcgagacgcccccgagttgggaacgggctaacgnggtggggactcgttaacgtaacg

SEQ ID NO: 398146 - DNA, 582 bp, Homo sapiens
  misc_feature: GZ8MTXP01A28C9.38.4.A04.1.454.CMB.2.raw
  modified_base (281)..(281): a, c, t, g, unknown or other
  modified_base (366)..(366): a, c, t, g, unknown or other
  modified_base (411)..(411): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccgattcgcatctcagagacaacgcaagactcactgngctgcacatgaacggctgagaggcgacgacacggctgtgtactttctgtgcgagacgccccccagtggagggctacaggtggganctacgactttgactacgtggggccagggacctggtcacgtctccncacgcctccaccgaacgggcccactccggtcccttcccccgtcggccctacccctccctacccgaacgacgccacctcgtcgggggccacgcggccggcccgttggggccttcgccgtcggttcgacgggactaaccttccgaaccgtgacgttcgaacgttcggaacggg

SEQ ID NO: 398147 - DNA, 550 bp, Homo sapiens
  misc_feature: GZ8MTXP01AB9EI.38.4.A04.1.454.CMB.2.raw
  modified_base (283)..(283): a, c, t, g, unknown or other
  modified_base (367)..(367): a, c, t, g, unknown or other
  modified_base (491)..(491): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaaggccgattcgccatctccagagacaacgccaagaactcactgnggctgcacatgaacggcctgagaggcacgacacggctgtgtactttctgtgcgagagccccccatggagggctacgagtggganctacgactttgactacgtggggccagggaaccctggcaccgtctcctcacgcctccaccaacgggcccagtccggtccttcccccgtggccaccctcctaccaagcgcacctcgtggggcacgngcggcccttgggcttgccgtgttcgaggctaactcaacgtgacttcgaacgttgaacgg

SEQ ID NO: 398148 - DNA, 600 bp, Homo sapiens
  misc_feature: GZ8MTXP01C60NW.38.4.A04.1.454.CMB.2.raw
  modified_base (263)..(263): a, c, t, g, unknown or other
  modified_base (303)..(303): a, c, t, g, unknown or other
  modified_base (550)..(550): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggcttggtccgaggccggggggtccctgagactctcctgtgcagcctntgcattcaacctttagtaactatttaatgagctgggtccncagcctcgagggaggggctggagtgggtgccagcattaaccaagatggaaccgtagaaaaatctatgtagggactcgtaggtggaaacggggccgaatttccggcctaattcctacccgaggaacgaacgaaccgaccaaaacggaactcaacgtgtcgctgacacgactggaaaccggccgtaggaggagggccgaacgacgacggtctgtgttaacttcgttggtcgacgacggaccgcccccgngttacgggaacgggcgtaacgagggtgggacgtccgttaacgtttaaccg

SEQ ID NO: 398149 - DNA, 582 bp, Homo sapiens
  misc_feature: GZ8MTXP01BOVP1.38.4.A04.1.454.CMB.2.raw
  modified_base (261)..(261): a, c, t, g, unknown or other
  modified_base (286)..(286): a, c, t, g, unknown or other
  modified_base (307)..(307): a, c, t, g, unknown or other
  modified_base (371)..(371): a, c, t, g, unknown or other
  modified_base (564)..(564): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaaggggctgggagtgggtggccagcaattaaccaagatggacgtagaaaaatctatgtggactctgtgaagggccattcgccatcncagagacaacgcaagaactcactgnggctgcacatgaacgctgagnggcgacgacacggctgtgtactttcgtgtgcgagcgcccccagtggaggctacgaggtgggacncgtacgtactttgaccgtacgtcgggggacctaacgggaccctggtccaccgtctcctcacgcctccaccgacggccagtccgtcccttccccgcgcccaccctccaccacgcgcaccgtcgtcggggcacgcggccggcccgttgggccttcggaccgtcgttacgacggttcctaacttccgaacgtcgancgtaacgttggaaccggg

SEQ ID NO: 398150 - DNA, 559 bp, Homo sapiens
  misc_feature: GZ8MTXP01A3S01.38.4.A04.1.454.CMB.2.raw
  modified_base (285)..(285): a, c, t, g, unknown or other
  modified_base (370)..(370): a, c, t, g, unknown or other
  modified_base (480)..(480): a, c, t, g, unknown or other
  modified_base (558)..(558): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccattcgccatctcagagacaacgccaagaactcactgngctgcacatgaacgctgagaggcacgacacggctggtgtacttcgtgtcgcgagacgtcccccagtgagggctacgaggtggganctacgtactttgaccttacggtcggggccagggtaccctggtcaccgtctcctcacgcctccaccgaacgggccactccggtcctccccgtcgccaccctccacaacgcncacctcgtcggggcacgcgcgcccgttgggcttcgcctggccgagggacctcttacccgcgtcgacttcgtcgttggng

SEQ ID NO: 398151 - DNA, 576 bp, Homo sapiens
  misc_feature: GZ8MTXP01BJ71N.38.4.A04.1.454.CMB.2.raw
  modified_base (282)..(282): a, c, t, g, unknown or other
  modified_base (338)..(338): a, c, t, g, unknown or other
  modified_base (357)..(357): a, c, t, g, unknown or other
  modified_base (366)..(366): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcaattaaccaagatggacgtagaaaaatctatgtggactctgtgaaggccattcgcatctccagagacaacgccaagactcactgnggctgcacatgaacgctgagaggcgacgacacggctgtgtacttctgtgcgagacncccccatggagggctacgnggtagggancgtacgtactttgactacgtcggggaccacgggaccgtcgtcaccgtctcctcacgcctccaccgacggccacgtcgtccttccccggtcgccgtaccctccctaccaacgacgccaccgtcgtcggggcacgcgccggcccgttgggcgttcgccgtcggttacgaacgggttactaactccgcgtcgacgttcgaacgttggaacggg

SEQ ID NO: 398152 - DNA, 726 bp, Homo sapiens
  misc_feature: GZ8MTXP01CYIMA.38.4.A04.1.454.CMB.2.raw
  modified_base (284)..(284): a, c, t, g, unknown or other
  modified_base (335)..(335): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcaattaaaccaagatggaacgtagaaaaaatactatgtggactctgtgaaggccattcgcatctcagagacaacgcaagactcactgnggctgcacatgaacggctaggagaggcgacgacacggctgtgtactttcgngtgcgagaccgcccccagtcggagggctaacgaggtacgggactccgtaacgtactttaggaccttaacgggtcgggggaccctaaaccggggaacccttcgggtccctacccggtcctcccgttaccgaaccgtcccctaccgaacccgaaaccggggccccctaacgttccccgggttcccctttccccccggggtcggtacccctaccccctacccgttacccgaaacgaccggaccctaccccgttcggtaccgggggaccaaccggaacccgggccccgggtcccggttccgggtccgttccggtcccgttacgggttaccgttaacggttaccctttaacccgtaccgtaacggttcgacgttaccgtaaccggcgggtaacggg

SEQ ID NO: 398153 - DNA, 545 bp, Homo sapiens
  misc_feature: GZ8MTXP01ARA4L.38.4.A04.1.454.CMB.2.raw
  modified_base (227)..(227): a, c, t, g, unknown or other
  modified_base (276)..(276): a, c, t, g, unknown or other
  modified_base (360)..(360): a, c, t, g, unknown or other
  modified_base (542)..(542): a, c, t, g, unknown or other
  modified_base (544)..(544): a, c, t, g, unknown or other
tcagtcgatcacgtcacgaccggtgctcgatttagagtagtgatcaggggaagaccgatgggcccttggggaggcttggtccagccggggggtccctgagactctcctgtgcagcctctgcattcacctttagtaactatttaatgagctgggtccgccagcctccagggaagggctggagtgggtgccagcattaaccaagatggactgaaaaatctatgtgactntgtgaagggccattcgccatctccagagacaacgccaagaactcactgnggctgcacatgaacggcctgagaggcgacgacacgggctgtgtactttctgtgcgagacgcccccatggaggctacagtggganctacgactttgactacgtgggggccagggaaccctggtcacgtctcctcacgcctccaccaacgggcccatccggtccttcccccgtggccacccctcctccaagcgcacctcgtgggggcacaggcggtcccgttggggcttcgccgtggcgaaggcctaactccaacgtcgattcgtcgngng

SEQ ID NO: 398154 - DNA, 549 bp, Homo sapiens
  misc_feature: GZ8MTXP01AWW5K.38.4.A04.1.454.CMB.2.raw
  modified_base (300)..(300): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcaccttagtaactatttaatgagctgggtccnccagcctccgagggggaaggggctgggagtggggtgccagcaattaaccaagatcggacgtagaaaatctatgtgaactcgtgtgaacggggccgtattcgcatctaccagagacaacgaccaaagactcactgtggctgcacagtgaaccggcctggagaggacgacgacgacggtctggtgtacttcgtgttcgcgacgacgcccccgagtgggacgggctacgaggttggggaacgcgttaaccgg

SEQ ID NO: 398155 - DNA, 745 bp, Homo sapiens
  misc_feature: GZ8MTXP01CTR9F.38.4.A04.1.454.CMB.2.raw
  modified_base (271)..(271): a, c, t, g, unknown or other
  modified_base (295)..(295): a, c, t, g, unknown or other
  modified_base (711)..(711): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatcgtggtaggggacagagtcaccatcacttgccggcagtcgagggcattaggacttcgttagcctggtatcagacaaaaaccgaggaaacncccctaaactctagatctatggtnctatcctagttttgacgtaaaggtcgggtacccagtacgaaggttcgaggcggacctaggtaggacgtccgtaggggaaaacctaaggtaactttccgaaacggttaccttaaccaaacctaaacgttccaaacgggtccaaacggtccccgttaggacccgtaggtaccccgtaggggtaaacgtaacttaacccgtagtaaacccttaaaagttttacttttaacgtttacggggttaacctttaaaccgtaacgtttaaacccttttaaaaccgttaaaccccggtttaaccccccctaaggtttaaacccgttttcgggaaacccggttaaacgggggtaacccttaaagggttcggaaaacgttagttaaaccgaaaacgtacgtcggttacggttcttaacgcctaactnttacttcgttaccttaacgttaaccgtttccccg

SEQ ID NO: 398156 - DNA, 525 bp, Homo sapiens
  misc_feature: GZ8MTXP01DPNQP.38.4.A04.1.454.CMB.2.raw
  modified_base (337)..(337): a, c, t, g, unknown or other
  modified_base (341)..(341): a, c, t, g, unknown or other
  modified_base (349)..(349): a, c, t, g, unknown or other
  modified_base (512)..(512): a, c, t, g, unknown or other
  modified_base (514)..(514): a, c, t, g, unknown or other
  modified_base (517)..(517): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagcgtggttttctgttgctatttagaaggtgtccagtgtgaggtgcaatggtggagtcgtgggggaggcttggtccaggccgggggggtccctgagactctcctgtgcagcctctgcattcaccttaagaactatttaatgagctgggtccgcagcctcaggggagggctggagtggtgccagcataacagangganagaaaatntatagtggaactcgtggtaggaaacggggccgaattcggacccattcctaccagacgaacaaacgacccaaagaaactcaactgtggctgcacatgaacggctgagaggcacgtacacggctgtgtaccttgtgttgcgagacgcccccagtgaggcgtacgngnggngcgtaacg

SEQ ID NO: 398157 - DNA, 593 bp, Homo sapiens
  misc_feature: GZ8MTXP01A582J.38.4.A04.1.454.CMB.2.raw
  modified_base (284)..(284): a, c, t, g, unknown or other
  modified_base (341)..(341): a, c, t, g, unknown or other
  modified_base (372)..(372): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccgattcgccatctcagagacaacgccaagactcactgngctgcacatgaacggcctgagaggcgacgacacggctgtgtacttcgtgtgcgagcncccccagtggagggctaacgaggtcgggacncgtaacgtactttggaacctacggtcggggggacccaacggggaacccctggtccacccgtcctaccctcacgccctaccgaccgaacgggccccacgtccggttcccttcccccggtggcccacccctccctaccaagcgccacctcggtcgggggccacgcggccgcccgttggcttcgcctggcgaggttctaactccaacgtgacttcgcgttgcgg

SEQ ID NO: 398158 - DNA, 604 bp, Homo sapiens
  misc_feature: GZ8MTXP01C48OX.38.4.A04.1.454.CMB.2.raw
  modified_base (283)..(283): a, c, t, g, unknown or other
  modified_base (331)..(331): a, c, t, g, unknown or other
  modified_base (373)..(373): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaaatctatgtggactctgtgaagggccattcgccatctcagagacaacgcaagactcactgnggctgcacatgaacggctgagaggcgacgacacggctgtgtactttcngtgcgagacgcccccccagtggagggctacgaggtaggggancgtaacgtactttgactacgtgggggaccacgggaaccctggtccaccgtctcctcacgccctccaccgaacgggcccactccggtcccttcccccgtcggcccacccctccctaccaacgacgccaccctcgtcgggggccaccgacggcccgggcccgttggggccttcggcccgtgggttaccgagggttaccttaacgtccaacgtgacttcgaacgttggaacggg

SEQ ID NO: 398159 - DNA, 598 bp, Homo sapiens
  misc_feature: GZ8MTXP01CQWAZ.38.4.A04.1.454.CMB.2.raw
  modified_base (459)..(459): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggccagtcagggctattaggacttcgtttagcctggtatcagacaaaaaccagaacgaaacgcccctaaacctcctagattctatggtcgactatccctaatttttgacgtaaaaggtcgggggtaccctagtacgtaaaggttcagccggacgaggtggatcgtagggaactaagtaattcagtctacaacaaatcagcacgcctgcaagcgtaggagatacagactaacttattatcgtactanagtacttaaactacgttaccccactacgtttcggaccgtaggggaacctaaaggttcgggaataacttaacgtaaaacgtacgttaggttcgaccttcggacctaaccgtacttccttacgttccctttaacgtaaccc

SEQ ID NO: 398160 - DNA, 600 bp, Homo sapiens
  misc_feature: GZ8MTXP01ESD06.38.4.A04.1.454.CMB.2.raw
  modified_base (286)..(286): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaagggccgattcgccatctccagagacaacgccaaagaactcactgnggctgcacatgaacggctgagaggcacgacacggctgtgtacttcgtgtgcgagacgcccccatggaggctacgaggtgggatcgtacgtactttgactacgtcgggggaccaacgggaccctgtccaccgtctcctcacgccctaccaccgaacggccccacgttccggtcccttccccggtcggacccacccctccctaccgaacgaccgccgtaccgttcggtcgggggaccacgcggccggcccgttgggccttcggccgtggttacgacggttacctctccgaagtcgacttcgtaacgttggaacggg

SEQ ID NO: 398161 - DNA, 555 bp, Homo sapiens
  misc_feature: GZ8MTXP01A9PD6.38.4.A04.1.454.CMB.2.raw
  modified_base (329)..(329): a, c, t, g, unknown or other
  modified_base (371)..(371): a, c, t, g, unknown or other
  modified_base (419)..(419): a, c, t, g, unknown or other
  modified_base (546)..(546): a, c, t, g, unknown or other
  modified_base (552)..(552): a, c, t, g, unknown or other
  modified_base (554)..(555): a, c, t, g, unknown or other
tcagtcgatcacgtcacgaccggtgctcgatttagagtagtgatcagggggggtccctgagactctcctgtgcagcctctgcattcacctttagtaactatttaatgagctgggtccgccagcctccgagggaaggggctggagtgggtggccagcattaaccaagatggacgtgaaaaatctatgtggactctgtgaagggccgattcgccatctccagagacaacgccaaagaactcactgtggctgcacatgaacggctgagaggcgacgacacggctgtgtacttctgtgcgagacgccccccagtgagggctacgaggtggganctacgctttgacctacggtggggccaggggaccctgggtccnccgtctcctcacgcctaccacgaacgggcccatccggtccttccccgngcccaccctcctaccagacgcctacctcgtcggggcacgacggccggcccgtgggcctcgccgtggtccgaaggcctaccttccgaacgtgactcgacgtgagggcgggcgttcggaacgaggccgntagagngnn

SEQ ID NO: 398162 - DNA, 572 bp, Homo sapiens
  misc_feature: GZ8MTXP01A2YUI.38.4.A04.1.454.CMB.2.raw
  modified_base (285)..(285): a, c, t, g, unknown or other
  modified_base (297)..(297): a, c, t, g, unknown or other
  modified_base (522)..(522): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttgggtccaggccgggggggtccctgagactctcctgtgcagcctctgcattcacctttagaactattaangagctgggtccnccagcctcgaggggaggggctggagtgggtgccagcattaaccaagatggacctagaaaatctatgtaggactctggtggaacggggcctattccgctatctacagagacaacgacaaagaactcacgtgtggctgcacgagtaggaaccgccgtaggagcggacgaccgtacgacgggtcttggtcgttaacttcgttggtcgccgaacggacccgacccccgngttcgggaacggggtctaaccgagggtcgggacgtccgttaacgttaacg

SEQ ID NO: 398163 - DNA, 554 bp, Homo sapiens
  misc_feature: GZ8MTXP01ETNMW.38.4.A04.1.454.CMB.2.raw
  modified_base (209)..(209): a, c, t, g, unknown or other
  modified_base (234)..(234): a, c, t, g, unknown or other
  modified_base (237)..(237): a, c, t, g, unknown or other
  modified_base (261)..(261): a, c, t, g, unknown or other
  modified_base (315)..(315): a, c, t, g, unknown or other
  modified_base (363)..(363): a, c, t, g, unknown or other
  modified_base (494)..(494): a, c, t, g, unknown or other
  modified_base (516)..(516): a, c, t, g, unknown or other
  modified_base (552)..(552): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcaccttttagtaactatttaatgagctgggtccgccagcctccgagggaaggggctggagtgggtggccagcattaaccaagntggacgtagaaaaatcatgtgactntgngaagggccattcgccatctccagngacaacgccaagaactcactgtggctgcacatgaacggctgagaggcgacgacncgctgtgtactctgtgcgagcgcccccatggagggctacgagtggganctaagactttggactcgtcgggggccagggaaccctggtccaccgtctcctcacgcctccaccaacgggcccactccggtccttcccccgcgtccaccctccaccaacgacgcgacctcgtcggggcacgnggccgccgttcggcttgccgtnttcgacgacgtaactcaacgtgattcgaacgttcgngg

SEQ ID NO: 398164 - DNA, 609 bp, Homo sapiens
  misc_feature: GZ8MTXP01BE82F.38.4.A04.1.454.CMB.2.raw
  modified_base (270)..(270): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggaggcgttgggtccgagggcccgggggggtccctgagactctcctgtgcagcctcngctattctacctttagaacttatttaatgagcgtgggtcccgccagccctccgaggggaggggctgggagtgggttgcccagcaattaaaccaagagtaggaaccgtagaaaaatctatggtaaggactcgtggtaggaacggggcctattccgctactctaccgaagacgaacaacgaccaaagactcacgtgtggctagccaagagtacggaaccggccgtaggagacgggaccgaccggacgaccgggtctggtcgtaacttcgttggtacgccggacgaccgcccccgagttcggaacgggcctaacgagggtgggacgtccgttaacgttaacg

SEQ ID NO: 398165 - DNA, 621 bp, Homo sapiens
  misc_feature: GZ8MTXP01ENB2U.38.4.A04.1.454.CMB.2.raw
  modified_base (270)..(270): a, c, t, g, unknown or other
  modified_base (293)..(293): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatcccttcctgtctgcatcgtggtaggggacagagtcaccatcacttgccggcagtcagggcattaggacttcgtttagcctggtatcagacaaaaccagggaacncccctaacctcctgatctatggngcatcctattttgacgtaaaggtcgggggtacccctagtacaaaggttcaaggcggccaggtggatcgtaggggaaaccaagtaatttcagtctacaactaatcagcagcctgcagcctaggatatactagtacctaatttattaacttgggtactaactagtactttaaagtacccgttacccctattaccgtttcggaccggtaagggtaaccctaagggttaacggaagttacgtaaaccgttaaaacggtaacgttcggttacgggttcttacggtaaccctacctaacgttctacggttacctttcgttaaccgtttcccccg

SEQ ID NO: 398166 - DNA, 626 bp, Homo sapiens
  misc_feature: GZ8MTXP01D02GV.38.4.A04.1.454.CMB.2.raw
  modified_base (309)..(309): a, c, t, g, unknown or other
  modified_base (334)..(334): a, c, t, g, unknown or other
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaaatactatgtggactctgtgaagggccgattcgcatctccagagacaacgccaagaactcactgtggctgcacatgaacggcctgaagnggcgacgacacggctgtgtacttcngtgcgagacgcccccatggagggctacgagtgggancgtaacgactttgactacgtcgggggccagggaaccctggtccaccgtctcctcacgtcctccaccaacgggcccaacgtccggtcccttcccccgtcggcccaccctccctacccgaacgacgccaacccgttcggtcgggggccaccgacggcccgggtcccgttggggccgttcggcccgttcgggttacgaaacgggttaccttaacctttacccgaacggttcgaacgttcggaaccgttgggaaccgggg

SEQ ID NO: 398167 - DNA, 551 bp, Homo sapiens
  misc_feature: GZ8MTXP01CEZ1B.38.4.A04.1.454.CMB.2.raw
  modified_base (329)..(329): a, c, t, g, unknown or other
  modified_base (426)..(426): a, c, t, g, unknown or other
  modified_base (432)..(432): a, c, t, g, unknown or other
  modified_base (435)..(435): a, c, t, g, unknown or other
  modified_base (442)..(442): a, c, t, g, unknown or other
  modified_base (451)..(451): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccaggccgggggggtccctgagactctcctgtgcagcctctgcattcacctttagaaactattaatgagctgggtccgcagccctcgagggaggggctggagtgggngccagcaattaaccaagataggacctagaaaaatctatgtaggactctgtgaaaggggccattcgccatctaccagagacaaacgccaaagtaaccncactgngcnacacganagacgacgngagaggacgacgacgacgcgtgtgtctcgttgtgcgacgaccgaccccgacgttacggaacggacgtaacgaggtacgggacggtaacgttaacgtaacg

SEQ ID NO: 398168 - DNA, 775 bp, Homo sapiens
  misc_feature: GZ8MTXP01EUGG5.38.4.A04.1.454.CMB.2.raw
  modified_base (284)..(284): a, c, t, g, unknown or other
  modified_base (289)..(289): a, c, t, g, unknown or other
  modified_base (292)..(292): a, c, t, g, unknown or other
  modified_base (296)..(297): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcttggtccgaggcccggggggtccctggagactctcctgtgcagcttctgcattcacctttagaactnttaanganctgnnggtcccgccacgcccgtccggagggggaagggggcgtgggaggtggggtcggaccgacgacgtaaacgttaaaacccgaaaaggtaagtaaacgggtaaacggtaagtaaaaaaacttaaacgttaagttagggtacgggtaaccgttacgttacgggtaggggtaaacgggggacccggtaacgttacccgacccgtaacgttacccgtacccgaaacggaaacgaaacccgaaacccgaacccgaaaacgtaaaccttaccgtaaccgttacgggtacgggtaccgtacgaacccgaaaccgtaaacggtaacgggaaacccgggtacccggtaacgggaaacgggaacggggaacccgggaaacccggaaaccgaaaccggttaaccgttacggttacggttaccgtttccgttcggtaacggaccggaacggaccccggaccccccgttaccggtaacgggaacggggtaaccg

SEQ ID NO: 398169 - DNA, 541 bp, Homo sapiens
  misc_feature: GZ8MTXP01EQGNC.38.4.A04.1.454.CMB.2.raw
  modified_base (284)..(284): a, c, t, g, unknown or other
  modified_base (297)..(297): a, c, t, g, unknown or other
  modified_base (371)..(371): a, c, t, g, unknown or other
  modified_base (440)..(440): a, c, t, g, unknown or other
  modified_base (491)..(491): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctatttagaaggtgtccagtgtgaggtgcaactggtggagtcgtggggggagcttggtccaggccggggggtccctgagactctcctgtgcagcctctgcattcacctttagaactattaangagctgggtcccncagcctccagggaaggggctggagtgggtgccagcattaaccaagatggaccgtagaaaaatctatgtagactngtgaagggctattcgcatctcagagacaacgcaaagaactcactgtgctgcacgatgaacggcctgagnggcgaacgcgacggctggtgttaacttcgttggtcgcgacgcgccccccgngttcgggaacgggctaacggagggtcggggactccgttaacggttaaccg

SEQ ID NO: 398170 - DNA, 595 bp, Homo sapiens
  misc_feature: GZ8MTXP01EKP5F.38.4.A04.1.454.CMB.2.raw
  modified_base (286)..(286): a, c, t, g, unknown or other
  modified_base (309)..(309): a, c, t, g, unknown or other
  modified_base (335)..(335): a, c, t, g, unknown or other
  modified_base (362)..(362): a, c, t, g, unknown or other
  modified_base (370)..(370): a, c, t, g, unknown or other
  modified_base (392)..(392): a, c, t, g, unknown or other
  modified_base (525)..(525): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcaattaaccaagatggacgtagaaaaaatctatgtggactctgtgaaggccattcgcatctccagagacaaacgcaaagaactcactgnggctgcacatcgaacgctgaagnggcgacgacacggctgtgtactttcngtgcgagcgcccccatggaggctacgngtgggacncgtaacgtactttgacttacgngggggaccaacggggaacctggtccaccgtctccctcgaacgccctaccgaaccgaacgggccccacgtccggttccttcccccgtggcccaccccttcccaccaacgacgccacccgttcgcggggcaacgnggccggcccgttgggccttgccgttgacgacggacttaaccttcaacgttggacttcgaacgttggcggg

SEQ ID NO: 398171 - DNA, 591 bp, Homo sapiens
  misc_feature: GZ8MTXP01D8GUN.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtgggggaggcgttggtccgagggccgggggggtccctgagactctcctgtgcagcctctgctattcacctttagtaacttatttaatgagcgtgggtccgccagcctccgagggagggcgtagaggtggggtgccagcattaaaccgaagtagtaggaaccgtagaaaaatactagtggtaggactcgtggtaggaaacggggcctaagttcggcctagtcctacaagacgacaacgaccaaagactcaacgtgtcgctgacacgaacgtaggaaccggcctaggagacgggcgaacgaccgtacggcttgtgtaacttcttggtcgcgacgaccgcccccgagcggaacgggctaacggaggtcgggacgtcgttaacgttaaccg

SEQ ID NO: 398172 - DNA, 584 bp, Homo sapiens
  misc_feature: GZ8MTXP01AY18I.38.4.A04.1.454.CMB.2.raw
  modified_base (370)..(370): a, c, t, g, unknown or other
tcagtcgatcacgtcacgaccggtgctcgatttagagtagtgatcaggggggaagaccgatgggcccttgggggaggcttggtccaggccgggggggtccctgagactctcctgtgcagcctctgcattcacctttagtaactatttaatgagctgggtccgccagcctccgaggggaaggggctggagtgggtggcagcattaaccaagatggacgtagaaaaatctatgtggactctgtgaagggcattcgcatctcagagacaacgcaagaactcactgtgctgcacatgaacggctgagaggcgacgacacggctgtgtactttctggtgcgagacgcccccagtggacggctacgaggtgggacnctacgtactttggacttacggtcgggggaccaacgggaacccgtcggtcaccgtctcctcacgcctccaaccgacggcccacgtccgtccttccccggtcggccaccctcctaccaacgacgccaccgtcgtcgggggccacgcggccggcccgttgggccttgccgtcggttcgacggttactaacctcgaacgtgacgttcgcgttggcggg

SEQ ID NO: 398173 - DNA, 573 bp, Homo sapiens
  misc_feature: GZ8MTXP01C6JSZ.38.4.A04.1.454.CMB.2.raw
  modified_base (305)..(305): a, c, t, g, unknown or other
  modified_base (444)..(444): a, c, t, g, unknown or other
  modified_base (523)..(523): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccaggcccgggggggtccctggagactctcctgtgcagcctctgcattcacctttagtaactatttaatgagcgtgggtcccncagccctccgaggggaaggggctgggaggtggggtggcccagcaattaaaccaagatggaaccgtagaaaaaatctatgtaggactcgtgtggaaacgggccgatcgcatctcagacgacaacgacaaagactcactgngctgcagacgtgaacgccgtagaggacggcgaacgcgtacggctgtgtaacttcgttggtcgcgacgaccgacccccgngttacggaacgggtctaacgagggtcgggacgtccgttaacggttaaccg

SEQ ID NO: 398174 - DNA, 676 bp, Homo sapiens
  misc_feature: GZ8MTXP01CTY6R.38.4.A04.1.454.CMB.2.raw
  modified_base (282)..(282): a, c, t, g, unknown or other
  modified_base (330)..(330): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaagggctggagtgggtggccagcattaaccaagatggacgtagaaaaatctatgtggactctgtgaagggccgattcgcatctcagagacaacgcaagactcactgngctgcacatcgaacggctgagaggcacgacacggctgtgtactttcgngtgacgacgccgccccagtggacggtctacgaggtacgggactccgtaacgtacgtttacggaccgtacgggcggggaccaaacgggtacccgtcggtacctacccgtcctccctacgaccgtcccctacccgaaccgaacggccctacgttcccggttccccttccccgggtcggacccctacccctcccgtaccgaacgtccgccgtacccggtcgggtcggggaccacgccgggcccggtcccggttggggtcccttcgggtcccgtacgggttaaccgaaccggttaccttaaccgttacccgtaacgttcggtacgttaccggtaacggttgggaaccggg

SEQ ID NO: 398175 - DNA, 540 bp, Homo sapiens
  misc_feature: GZ8MTXP01BE4NJ.38.4.A04.1.454.CMB.2.raw
  modified_base (255)..(255): a, c, t, g, unknown or other
  modified_base (282)..(282): a, c, t, g, unknown or other
  modified_base (290)..(290): a, c, t, g, unknown or other
  modified_base (339)..(339): a, c, t, g, unknown or other
  modified_base (485)..(485): a, c, t, g, unknown or other
  modified_base (501)..(501): a, c, t, g, unknown or other
  modified_base (519)..(519): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaggtgtcagtgtgaggtgcaactggtggagtcgtgggggagcttgggtccaggccggggggtcctgagactctcctgtgcagcctntgcattcactttagaactattaatganctggtccncagcctcgagggagggctggagtgggtcggccaggcaattaaccgaagngtaggaaccgtaggaaaaaatctaatgtaaggactcgtgtagaacgggccattcgcctatctccagacgacaacgccaaagactcactgtgctgcacatcggaaaccgctggagacggcgacgacacgggtctggtgtaacttcgngtgcgagcgcccccgngttggaaggctaacgggnggtacggacgtcgttaacgtg

SEQ ID NO: 398176 - DNA, 624 bp, Homo sapiens
  misc_feature: GZ8MTXP01DODWE.38.4.A04.1.454.CMB.2.raw
  modified_base (320)..(320): a, c, t, g, unknown or other
  modified_base (336)..(336): a, c, t, g, unknown or other
  modified_base (528)..(528): a, c, t, g, unknown or other
  modified_base (621)..(621): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaaggccattcgcatctccagagacaacgcaagaactcactgtggctgcacatgaacggctgagaggcgacgacacggctgtntacttgtgtgcgagcncccccctagcggagggtctacgaggtcgggagtcgtacgtacgtttacgacgtacggtcgggggccgaacgggaacccgtggtccaccgtctccctcacgccctccaccgaccggcctacgtccgtcccttccccggttcgaccctaccctcctaccgaacgcgaccaccgtcggtccggggacgaacccgngggccccggtccggttcgggtccgttcgtcccgtggttaaccgacggttaccttaaccgtaccgaacggttacgacgttccgaacgttcgggnggg

SEQ ID NO: 398177 - DNA, 587 bp, Homo sapiens
  misc_feature: GZ8MTXP01EFD8E.38.4.A04.1.454.CMB.2.raw
  modified_base (300)..(300): a, c, t, g, unknown or other
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttggcccagtctccatccttcctgtctgcatcgtggtaggggacagagtcaccatcacttgccgggccagtcagggcagttaggacttcgttagcctggtatcaagacaaaaaccgagggaaacgcccctaaactcctgatctatggtnctatcctattttgactaaaggtcggggtacccagtacgaaggttcagcggccaggtggatcgtagggaaacagtaacttcagtctacaacgaatcagcagcctgacagccgtaggagatactagactaattattattggtactaatacgtacttaaacgtaccgttaacccccagttacgtttggacccgtaggggtaaccctaagggttaacgaaggttactaacgaaacgtacgtggagggcttacggcctactaattctacgttccttaaccttcgtttccccg

SEQ ID NO: 398178 - DNA, 584 bp, Homo sapiens
  misc_feature: GZ8MTXP01BPL27.38.4.A04.1.454.CMB.2.raw
  modified_base (286)..(286): a, c, t, g, unknown or other
  modified_base (372)..(372): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcacctttagtaactatttaatgagctgggtccgccagcctccgagggaaggggctggagtgggtggccagcaattaaccaagatggacgtagaaaaaatctatgtggactctgtgaagggccattcgccatctccagagacaacgccaaagactcactgnggctgcacatgaacggctgagaggcgacgacacggctgtgtactttctgtgcgagaccgcccccagtggaggctacgaggtggganctacgtactttgactacgtggggccagggaccctggtccacgtctcctcacgcctccaccgaacgggcccacgtccggttccttcccccgtggcccacccctcctaccaacgacgccacctcgtcggggccacgcgccggccgttgggccttcgccgtggttacgaacggttactaaccttccgaacgttcgacgttcgaacgttgaacggg

SEQ ID NO: 398179 - DNA, 636 bp, Homo sapiens
  misc_feature: GZ8MTXP01E1XQX.38.4.A04.1.454.CMB.2.raw
  modified_base (288)..(288): a, c, t, g, unknown or other
  modified_base (299)..(299): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttggtccaggcgtgggggggtccctgagactctcctgtgcagcctctgctattctacttagtaactattaangagctggtccncagcctcgaggggagggctggaggtgggtcgccagctaattaaccgaagtagtacggaacgtagaaaaaatctagtaggttaggaacttcgtaggtagggaaacggggtcccgtaagttccgaccctaattcccgtaccgaaggaacgaaccgaaacgacccaaagtaacctcgaacgtgtacggctcgaccaacgtaagtacggaaaccgggccgtaggacgggacggaccggaaccgacgaccgggcttggtcgttaacttcgtagttcggcgaacgcccgcccccgagtcgggacgggtcctaacggagggttacgggaacgttcgttaaccgg

SEQ ID NO: 398180 - DNA, 692 bp, Homo sapiens
  misc_feature: GZ8MTXP01A42PG.38.4.A04.1.454.CMB.2.raw
  modified_base (298)..(298): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtcctgagactctcctgtgcagcctctgcattcaccttagtaactatttaatgagctgggtccncagcctcgaggggaaggggctggagtgggtggccagcattaaccaagatcggacgtagaaaaatctagtgtggaactcgtaggtaggaacggggcccgtaagttccgacctatcctacccgaaggaacgaaccaaaccggacccaaacgaaaccttccgaacgttggtacgggactcgggaccaacgtaagtacgggaaaccgggtcccgtagggaaggacgggaccggaaaccggtaacccggaaccggggtccttagggtcgggtttaacccttttcggtgggttcggaccgggtaacgggaacccgttcccccccccgaagggttcgggaacgggggtaacccttaaacgggggtacggggttacgggggtaacgttaacccggttaacgg

SEQ ID NO: 398181 - DNA, 557 bp, Homo sapiens
  misc_feature: GZ8MTXP01AEYVJ.38.4.A04.1.454.CMB.2.raw
  modified_base (268)..(268): a, c, t, g, unknown or other
  modified_base (292)..(292): a, c, t, g, unknown or other
  modified_base (538)..(538): a, c, t, g, unknown or other
  modified_base (550)..(550): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccggcagtcagggcattaggacttcgttagcctggtatcagacaaaaccgaggaaacncccctaacctctgatctagtggtnctatcctattttgactaaaggtcgggtcccagtacgaaggttcaggcggcaggtggatcgtagggaaacagtaacttcagtactcaacgtatcacgcagccctgacacgcctagggaacaatacgtgtaactaaactttatttaatcggttactaacgtagtacttaactaaccgttaccccacttacgtttcgaccgtaacgggacctaaggtgacgataacaaacgtactgcggcttcgcactnttctgttcttcncgttccc

SEQ ID NO: 398182 - DNA, 579 bp, Homo sapiens
  misc_feature: GZ8MTXP01B9QAJ.38.4.A04.1.454.CMB.2.raw
  modified_base (283)..(283): a, c, t, g, unknown or other
  modified_base (359)..(359): a, c, t, g, unknown or other
  modified_base (366)..(366): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaaatactatgtggactctgtgaagggccattcgcatctccagagacaacgcaagaactcactgnggctgcacatgaacggcctgagaggcgacgacacggctgtgtacttctgtgcgagacgcccccatgagggctacgngtggganctacgtactttgactacgtggggccagggaaccctgtcaccgtctcctcgacgcctacccgaccgaacgggccccacgtccgtcccttcccccggtcggcccacccctccctaccaacgacgccacctcgtcgggggcacgcgccggcccgttgggcttgccgtggttccgaggactaacttccgaacgtcgacttcgtaacgttggaacggg

SEQ ID NO: 398183 - DNA, 599 bp, Homo sapiens
  misc_feature: GZ8MTXP01C3LVK.38.4.A04.1.454.CMB.2.raw
  modified_base (280)..(280): a, c, t, g, unknown or other
  modified_base (324)..(324): a, c, t, g, unknown or other
  modified_base (361)..(361): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaaggccattcgcatctcagagacaacgcaagaactcactgngctgcacatgaacggctgagaggcacgacacggctgtgtacttngtgcgagacgcccccagtgagggctacgaggtggganctacgtactttggaactacgtgggggccaaggggaaccctggtccaccgtctcctacacgccctaccaccgaacgggcccacgtccgggtcccttcccccggtcggccctacccctccctacccgaaacgaccgcctaacccgtcgtcgggggaccacgacggccggcccgttggggcttcgccgtggttacgaacggacctaacttccaaccgttgacgttcgaacgttggaacggg

SEQ ID NO: 398184 - DNA, 759 bp, Homo sapiens
  misc_feature: GZ8MTXP01BTJPH.38.4.A04.1.454.CMB.2.raw
  modified_base (284)..(284): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcacctttagtaactatttaatgagctgggtccgccagcctccgagggaaggggctggagtgggtggccagcaattaaccaagatggacgtagaaaaatctatgtggactctgtgaagggccattcgccatctcagagacaacgcaagactcactgnggctgcacagtgaacggcctgagaggcgacgacacggctgtgtacttctgtcgcgacgaccgcccccagtggagggctaacgagggtacggggacgtccgttaacggtaacttttcggaaccgttaccgggtcggggggacccgtaaacgggggtaaccccgttcgggtacccgtaacccggttcctccccgtaccgaacccgtccccttaccccgaacccggaaaccggggccccctaaccggttccccggggtttccccctttccccccggggttaccgggtaccccctaacccccttaccccgtaacccgaaacggaccggaccctaaccccgtccgggttccggggggaccaccgacgggcccgggtccccggttcggggtcccgttcggtcccggttcgggttaccgaaacggttacccgtttaaccgttcccgtaacggttcgacgttaccggaacgttcgggaacggg

SEQ ID NO: 398185 - DNA, 646 bp, Homo sapiens
  misc_feature: GZ8MTXP01BJN4W.38.4.A04.1.454.CMB.2.raw
  modified_base (318)..(318): a, c, t, g, unknown or other
  modified_base (333)..(333): a, c, t, g, unknown or other
  modified_base (583)..(583): a, c, t, g, unknown or other
  modified_base (622)..(622): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggtttttccttgttgcttattttagaaggtgtccagtgtgaggtgcaactggtggagtcgtggggggaggtcgttgggtccgaggggcccggggggggtccctggacgtacctctccgtggtcgcacgcctctgcctattcctaacccttttaagtaaacttatttaaangagcgtcgggtcccnccagccctccgagggggaaggggctgggaggtggggtcggccaggcaattaaaccgaagagtaggaaccgttaagaaaaaatctaagtggtaaggactcgtaggtagaaacggggtcctagtttccgaccaactcctaccaaggaacgaaccaaaccggacccaaagaacctcacgttgcggctagaccacgagtacggaaccggcctaggacggacggccgaacgaccgacggtctggtacttcttcgngtcgcgacgaccgcccccgagttcgggaacggtcaacgngggtggacgtccgttaacgtaacg

SEQ ID NO: 398186 - DNA, 530 bp, Homo sapiens
  misc_feature: GZ8MTXP01DACB2.38.4.A04.1.454.CMB.2.raw
  modified_base (475)..(475): a, c, t, g, unknown or other
  modified_base (484)..(484): a, c, t, g, unknown or other
  modified_base (489)..(489): a, c, t, g, unknown or other
  modified_base (507)..(507): a, c, t, g, unknown or other
tcagtcgatcacgtcacgaccggtgctcgatttagagtagtgatcaggggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttggtccaggccgggggggtccctgagactctcctgtgcagcctctgcattcacctttagtaactatttaatgagctgggtccgcagcctccgagggaaggggctggagtggggtggccagcattaaccagatggaccgtagaaaaatctatgtaggacttcgtgtggaagggccgattcgccatctccagagacaacgacaagactcactgtgctgcacatgaacgctgagaggcgacgacaggctgtgtaacttcngtgcgagcnccccngttcggaagggctaacgnggtgggagtccgttaagttaacg

SEQ ID NO: 398187 - DNA, 586 bp, Homo sapiens
  misc_feature: GZ8MTXP01DFCSG.38.4.A04.1.454.CMB.2.raw
  modified_base (418)..(418): a, c, t, g, unknown or other
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttggcccagtctccatccttcctgtctgcatcgtgtaggggacagagtcaccatcacttgccgggccagtcagggctattaggacttcgttagcctggtatcaagacaaaaaaccgagggaaacgcccctaaactcctagatctagtggtgcatcctattttgactaaaggtcgggtaccatcgaaaggttcagcggcagtgatcgtagggaacagaattcagtctacaactatcaagcacgcctgacagacctgggaatatacgtnactaacttattattggtactatacgtacttaaataccgttacccctagtaacgttttcggaccgtaaggggtacctaaaggttggaagagtaccgaaaacggtaaactcgggttaaggttcacggtaacctacgtaacgttcgtcgttacttccgttaacgtttcccc

SEQ ID NO: 398188 - DNA, 581 bp, Homo sapiens
  misc_feature: GZ8MTXP01DTZ0W.38.4.A04.1.454.CMB.2.raw
  modified_base (348)..(348): a, c, t, g, unknown or other
  modified_base (529)..(529): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcttgggtccaggcccgggggggtccctgagactctcctgtgcagcctctgcattcaacctttagaactattaatgagctgggtccgcagcctcgagggaggggctggagtgggtgccagcattaaccaaganaggaaccgtagaaaaatctatgtagggactcgtggtggaaacggggccattccggcctatcctaccagacgaacaaccgaccaaaagaactcactgtcggctgacacgatcggaaaccgccgtggaagaggcgaagcgacggtctgtcgtaacttcttggtcgacgaggaccgacccccgngttacggaaggggtactaacggagggtagggacgtccgttaacggttaaccg

SEQ ID NO: 398189 - DNA, 565 bp, Homo sapiens
  misc_feature: GZ8MTXP01B9JXT.38.4.A04.1.454.CMB.2.raw
  modified_base (273)..(273): a, c, t, g, unknown or other
  modified_base (310)..(310): a, c, t, g, unknown or other
  modified_base (441)..(441): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggaggctttgggtccgagggcccgggggggtccctggacgactctccgtgtgcagccctntgcattcacctttagaactattaatgagctgggtccnccagccctcgagggagggctggagtgggtgccagcattaaccaagatggaaccgtagaaaaatcgtatgtaggactcgtgtaggaacgggccattcgccatctacagagacaacgaccaaagactcactgngctgcacgatcgaacggcctaggagacggcgacgacgacggctgtgtaacttcgttggtcgcggacgccgcccccgagttcgggaacgggctaacgagggtgggacgtccgttaacgttaaccg

SEQ ID NO: 398190 - DNA, 601 bp, Homo sapiens
  misc_feature: GZ8MTXP01DSS4U.38.4.A04.1.454.CMB.2.raw
  modified_base (240)..(240): a, c, t, g, unknown or other
  modified_base (288)..(288): a, c, t, g, unknown or other
  modified_base (308)..(308): a, c, t, g, unknown or other
  modified_base (332)..(332): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaaggggctggagtgggtggccagcaattaaaccaagatggacgtagaaaaaatctatgtggactntgtgaaggccattcgccatctcagagacaacgccaaagaactcactgngctgcacatgaacgctgagnggcacgacacggctgtgtacttcngtgcgagccgcccccagtggaggctacgaggtgggatctaacgtactttgacctacggtcgggggaccaacgggaacccgtcggtacctaccgtcctcctcacgccctaccgaccgaacgggcccacgtccggtcccttccccggtcggccctacccctccctaccaacgcgcctaccgtccgtgggggccacgcggccggccgttggggcttcggccgtggttacgacggttacctaacttccaacgtgacttcgtcgttggaacggg

SEQ ID NO: 398191 - DNA, 531 bp, Homo sapiens
  misc_feature: GZ8MTXP01EW1X3.38.4.A04.1.454.CMB.2.raw
  modified_base (475)..(475): a, c, t, g, unknown or other
  modified_base (493)..(493): a, c, t, g, unknown or other
  modified_base (510)..(510): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctggggggaggcttggtccaggccgggggggtccctgagactctcctgtgcagcctctgcattcacctttagaactatttaatgagctgggtccgccagccctccgaggggaaggggctgggagtgggtggccagcattaaccaagatggaccgtagaaaaatctatgtaggactctgtgaagggccattcgcatctccagagacaacgccaagactcactgtgctgcagatgaacgcctgagaggcgacgacgcggctggtgtaacttcgngtcgcgagacgcccccgnttcggaagggctaacgnggtgggagtcgttaacgtaag

SEQ ID NO: 398192 - DNA, 770 bp, Homo sapiens
  misc_feature: GZ8MTXP01ALRLC.38.4.A04.1.454.CMB.2.raw
  modified_base (302)..(302): a, c, t, g, unknown or other
  modified_base (338)..(338): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtgctatttagaaggtgtcagtgtgaggtgcaacgtggtggagtcgtgggggagtcttggtccgagggccggggggtccctggagactctcctgtgcagcctctgctattctacctttagaacttatttaatgagtcgtcgggtcccnccacgtcccgtccggaagggggagggggctaggggnggtgggggtcggacccaggactaaacttaaaccgaagtagtacgggaaacccgtaaggtaaaaaaattcgtaagtggtaacgggacttcgtagggtacgggaaacggggccctaagttccggaccctaattccctaccgaaggaacggaaacccaaacggacccttaaaacggaaaccttcgaaccgttggtacggtaccgtcggaccgaaccgtaagtaacgggtaaaccgggtaccccggtacggaagggaacggggaccgggaacccggaacccggaaccgggtacccggtacggttaggtttaaccgttccgttcgggttggccggtaaccgggaacccgttccccccgttaaccggttcgggtaaccggggtacggtaaccggtaacgggggtacgggttacggtaaccggttaaccggttaaccgg

SEQ ID NO: 398193 - DNA, 568 bp, Homo sapiens
  misc_feature: GZ8MTXP01DZ5QW.38.4.A04.1.454.CMB.2.raw
  modified_base (264)..(264): a, c, t, g, unknown or other
  modified_base (522)..(522): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcgttggtccgaggcccggggggtccctgagactctcctgtgcagccctntgctattcacctttagtaacttatttaatgagcgtgggtcccgccagccctccgaggggaggggctggagtgggtgccagcattaaccagataggaccgtagaaaatctatgtaggactcgtgtggaaacgggcctattcgcctatctaccagacacaacgacaaacgactcacgtgtcgctgcacgatggaacgcagagacggcgaacgcgacggcttgtcgtaacttcgttggtcggaccgacgcccgacccccgngttcgggaacgggtctaacgagggtgggactccgttaacgttaacg

SEQ ID NO: 398194 - DNA, 595 bp, Homo sapiens
  misc_feature: GZ8MTXP01AW7K4.38.4.A04.1.454.CMB.2.raw
  modified_base (309)..(309): a, c, t, g, unknown or other
  modified_base (555)..(555): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccgagggccgggggggtccctggagactctcctgtgcagcctctgctattcacctttagtaaacttatttaatgagcgtgggtcccncagcctccgagggagggctggagtgggtgccagcaattaaccaagatcggaaccgtagaaaatctagtgtagggactcgtgtaggaacggggtccagtttccgctatcctaccaaggaacgaaccaaaccgaccaaacgaactacaccgtggtcgctgaccacgaagtacggaaaccggccgtaggaacggacggacgaacgacgaccgggtctgtgtaacttcttaggtgcgagtaccgccccgnttggaacgggctaacgaggtcgggagtcgttaacgtaacg

SEQ ID NO: 398195 - DNA, 514 bp, Homo sapiens
  misc_feature: GZ8MTXP01B0W15.38.4.A04.1.454.CMB.2.raw
  modified_base (297)..(297): a, c, t, g, unknown or other
  modified_base (322)..(322): a, c, t, g, unknown or other
  modified_base (333)..(334): a, c, t, g, unknown or other
  modified_base (397)..(397): a, c, t, g, unknown or other
  modified_base (491)..(491): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttgggtccaggcccgggggggtccctgagactctcctgtgcagcctctgcattcacctttagaactattaatgagctggtccncagcctcgaggaggctggagtggtncagcatacagnngacgtagaaaatctatgtagactctgtgaagggccattcgcatctcagagacaacgcaagacncactgtgctgcacgatcgaacggcctgagaggcgacgactaggctgtcgtaacttcttggtcgcgagccgccccgagttcggaagggctaacgnggtgggacgtcttaacggtaacg

SEQ ID NO: 398196 - DNA, 608 bp, Homo sapiens
  misc_feature: GZ8MTXP01B19WE.38.4.A04.1.454.CMB.2.raw
  modified_base (275)..(275): a, c, t, g, unknown or other
  modified_base (301)..(301): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggccagtcagggctattaggacttcgtttagcctggtatcagaacaaaaccgagggaaaccncccctaactcctagactctagtggtnactattcctattttgacgtaaaggttcgggtacccagtcgtaaggttcaggcggctaggtggatcgtagggaaacagtaattcagttctacacaatcagcacgcctgcacgccgtagggactatacgtagtactaactttattacgttggtactactacgtactttaacgtacccgttacccctagttaccgtttcggaccggtaagggtaacccgtaaggttaacggaacgttaacgtaaccgaaacgtaaccgtggttacggttcttacgcctactaacttctcgttacttcttaacgttccccg

SEQ ID NO: 398197 - DNA, 734 bp, Homo sapiens
  misc_feature: GZ8MTXP01AT2OW.38.4.A04.1.454.CMB.2.raw
  modified_base (280)..(280): a, c, t, g, unknown or other
  modified_base (302)..(302): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttcggcccagtctccatccttcctgtctgcatcgtggtaggggacagagtcaccatcacttcggccgggccagtcgagggctagttaggacttcgtttagcctggtatcaagacaaaaacgagggaaacncccctaactctgatctatggtncatcctatttagacgtaaggtcgggggtaccctagtacgtaacggttcacggccggtaccgtaggtagggtatccggttagggggaaacctaaagggtaactttacgtaaacggttccttaccaaactaaacttacgaaacggcctaaacgggtcccctaaggcccgtaaacggtcccgttaaggggactaacgttaccgtacggtaaccttaaacgttttaatttacgttacgttaaccttaactaacggtttaacctttaaaccgtacccgtttaaacccccacgtttaaccggttttacgggaacccgtaacgggggtaaccctaagggttaacggggtaacttaaacgttaaccgaaacgtaaccgttgggttaccgcgttacgaaccctactaacttccgttattaccttccgttaactttcccccg

SEQ ID NO: 398198 - DNA, 579 bp, Homo sapiens
  misc_feature: GZ8MTXP01BGHBA.38.4.A04.1.454.CMB.2.raw
  modified_base (283)..(283): a, c, t, g, unknown or other
  modified_base (357)..(357): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccattcgccatctccagagacaacgcaagactcactgngctgcacatgaacggctgagaggcgacgacacggctgtgtacttctgtgcgagcgcccccagtggaggctacgnggtgggagctacgtactttgactacgtcggggccacgggaccctggtcaccgtctcctcacgcctcaccgacggcccagtccggtcccttccccggtcggcccacccctccctaccaacgacgcctaccgtcgtcgggggccacgcggtccggcccgttgggccttcggccgtggttacgacggttcctaaccttccgaacgtgcttccgtaacgttgcggg

SEQ ID NO: 398199 - DNA, 594 bp, Homo sapiens
  misc_feature: GZ8MTXP01A42Y0.38.4.A04.1.454.CMB.2.raw
  modified_base (284)..(284): a, c, t, g, unknown or other
  modified_base (374)..(374): a, c, t, g, unknown or other
  modified_base (538)..(538): a, c, t, g, unknown or other
  modified_base (548)..(548): a, c, t, g, unknown or other
  modified_base (591)..(591): a, c, t, g, unknown or other
  modified_base (593)..(593): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaagggctggagtgggtggccagcattaaccaagatggacgtgaaaaatctatgtggactctgtgaagggccgattcgccatctccagagacaacgcaagaactcactgnggctgcacatgaacggctgagaggcgacgacacggctgtgtactttctgtcgacgagacgcccccaagtggaggggctacgaggtggggnctacggtacttttgacgttacgtcgggggaccaacggggaaccctggtccaccgtctcccgtacacgcccctaccacccgaaacgggcccctaagtccgggttcccttcccccggtggccctacccctccctaccaaacgcgccaccgtcgtgggggccaacgngccgggtccngggcttgacctggacgaggctaactcgaacgtgattcgtaagngng

SEQ ID NO: 398200 - DNA, 697 bp, Homo sapiens
  misc_feature: GZ8MTXP01BMHJK.38.4.A04.1.454.CMB.2.raw
  modified_base (309)..(309): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcacatggaattggggctgagtcttgggttttccttgttgcttattttagaaggtgtcagtgtgaggtgcaagtggtggagtcgtgggggagtcgttggtccgagggccggggggtccctggacgctctccgtgtcgcacgcctctgctattcctactttagtaactattaatgagcgtcggtcccncacgccctacggaggggaaggggctaggaggtgggtcggccaggctaattaaccgaagagtggtaaccgtaagaaaaaattcgtatggtaacggtactcgtaggtaggggaaacggtccgtaattcggacctaagttcccaccgaagaaacggaaccaaaccgaccgaaaacggaacctactaaccgtggttacgggacttacgaccaaccgaaggttacggaaaccgtcccggaggaacggagggaccggaaccgtaacgacccggtcgtcgtcggttaaccttgttcgggttcgaccggtaacggaccccggttacccccgacggttcgggaaccgggtcgttaaccggaggggtcgggttaactccggttaacgtttaaccccgg

SEQ ID NO: 398201 - DNA, 580 bp, Homo sapiens
  misc_feature: GZ8MTXP01A3JK8.38.4.A04.1.454.CMB.2.raw
  modified_base (348)..(348): a, c, t, g, unknown or other
  modified_base (355)..(355): a, c, t, g, unknown or other
  modified_base (557)..(557): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtggggggaggcttgggtccgaggccggggggggtccctgagactctcctgtgcagcctctgctattccccactttagaacttattaatgagcgtgggtccgcagcctccgagggagggctggagtgggtgccagcataacaganggactanaaaatctatgtaagactcgtgtaggaaacgggccgtaagttcgacctatcctacccgaaggacgaacaacgaccaaacgactcaactgtcggctgacaacgagtaggaaaccggccgtaggaacggacggaccggaacgacgaccggtctgtcgtaacttcgttggtcgcgacgaccgccccgagttcggaagggctaacgnggtgggacgtcgttaacgtaacg

SEQ ID NO: 398202 - DNA, 654 bp, Homo sapiens
  misc_feature: GZ8MTXP01CH31K.38.4.A04.1.454.CMB.2.raw
  modified_base (287)..(287): a, c, t, g, unknown or other
  modified_base (335)..(335): a, c, t, g, unknown or other
  modified_base (347)..(347): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcaccttttagtaactatttaatgagctgggtccgccagcctccgagggaaggggctggagtgggtggccagcaattaaccaagatggaacgtagaaaaaatctatgtggactctgtgaaggcctattcgccatctcagagacaacgcaagactcactgngctgcacatgaacggctggagaggcgacgacacggctgtcgtactttnggtgcgagaccncccccagtggacgggtctacgaggtggggactctaacggtatttggaccttacggcgggggaccaacgggaaccctggtccaccgtctcctcgaccgtccctaccgaacccgaacggacccctacgttcccgtcccctttacccccggtcggccctacccctccgtaccgaacgccgacctacccgtcgtccgggggccaaccgcggcccggcccggttcgggccgttccgacccggttcggaaccgaacggttacccttaaccttacccgaacggttacgacgttacggaacgttcgggaaccggg

SEQ ID NO: 398203 - DNA, 618 bp, Homo sapiens
  misc_feature: GZ8MTXP01CKFT8.38.4.A04.1.454.CMB.2.raw
  modified_base (284)..(284): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacaacgccaagaactcactgnggctgcacatgaacggctgagaggcgacgacacggctgtgtacttctgtgcgagcgcccccagtgagggctacgaggtgggganctacgtactttgactacgtgggggccagggaccctggtccaccgtctcctcacgccctccaccgaacgggccccaacgtccggtccctttcccccggtgggcccctaccccttcccaccaaacgcgccctacccgtcgtcgggggccaccgcggcccggcccgttggggccttcggtccccgtgggttaccgaacgggttacccttaaccgtttccgaacgttgacgttccggaaccttgggaaccgggg

SEQ ID NO: 398204 - DNA, 570 bp, Homo sapiens
  misc_feature: GZ8MTXP01DJP1Q.38.4.A04.1.454.CMB.2.raw
  modified_base (282)..(282): a, c, t, g, unknown or other
  modified_base (303)..(303): a, c, t, g, unknown or other
  modified_base (329)..(329): a, c, t, g, unknown or other
  modified_base (365)..(365): a, c, t, g, unknown or other
  modified_base (518)..(518): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtgaaaaatctatgtggactctgtgaaggccgattcgccatctccagagacaacgccaagactcactgngctgcacatgaacggctgagnggcgacgacacggctgtgtactttcngtgcgagcgcccccatggagggctacgaggtggganctacgtactttgactacgtggggaccacgggaccctgtcaccgtctcctcacgccctccaccgaacggcccacgttccggtcccttcccccgtcggccctaacccctccctccaacgacgcacccgtcgtcgggggccacgacgccggcccgngggcttcgtccgtggacacggactctcgaacgtgacttcgaagttggaacgg

SEQ ID NO: 398205 - DNA, 654 bp, Homo sapiens
  misc_feature: GZ8MTXP01CNQLM.38.4.A04.1.454.CMB.2.raw
  modified_base (276)..(276): a, c, t, g, unknown or other
  modified_base (300)..(300): a, c, t, g, unknown or other
  modified_base (394)..(394): a, c, t, g, unknown or other
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttggcccagtctccatccttcctgtctgcatcgtggtaggggacagagtcacatcacttcgccggcagtcgagggctagttaggacttcgttagcctggtatcaagaacaaaaaccgaggaaacncccctaaactctagatctatggtnctatcctatttgacgtaaaggtcgggtacccagtcgaaggttcaggcggacgaggtggactcgagggaaacaagtaactcgaagttcctacaanaactcaagcctagcccgtgacgacgaccgtagggatactacgtagtaacttaaactttatttacgttacggtaaccttaacgtaacgttacctttaaaccgttacccgttaaaccccctagtttaaccggttttacgggaacccggtaacggggtaacccgtaaagggttaacggtaaacgttaaacgttaaaccgaaaacggtaacgttggttacggcttacgaacctactaattctacgttctaaccgttctttcccg

SEQ ID NO: 398206 - DNA, 611 bp, Homo sapiens
  misc_feature: GZ8MTXP01BQIEU.38.4.A04.1.454.CMB.2.raw
  modified_base (281)..(281): a, c, t, g, unknown or other
  modified_base (321)..(321): a, c, t, g, unknown or other
  modified_base (327)..(327): a, c, t, g, unknown or other
  modified_base (354)..(354): a, c, t, g, unknown or other
  modified_base (363)..(363): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggcattcgccatctcagagacaacgccaagactcactgnggctgcacatgaacggctggagaggcgacgcacggctgtntacttngtgcgagcgcccccatggaggctacgnggtgggacnctacgactttgacctacgtcgggggaccaacgggaccctggtccaccgtctcctcacgccctccaccgaacgggcccctacgtccgtcccttccccggtcggccctaccccgtcctaccaacgccgccgtaccgtcggtacgggggcccaacgccggccggccccgttggggtccttcggcccgtgggttacccgacgggttaccttaaccgtttccgcggttcgacgttccggaacgttggaacggg

SEQ ID NO: 398207 - DNA, 538 bp, Homo sapiens
  misc_feature: GZ8MTXP01AY18F.38.4.A04.1.454.CMB.2.raw
  modified_base (298)..(298): a, c, t, g, unknown or other
  modified_base (518)..(518): a, c, t, g, unknown or other
  modified_base (527)..(527): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccggggggtcctgagactctcctgtgcagcctctgcattcacttagtaactatttaatgagctgggtccnccagcctccgaggggaaggggctggagtgggtgccagcattaaccagatcggacgtagaaaatctatgtgaactctgtagaagggccgattcgccatctccagagacaacgaccaaagaactcactgtcggctgacacagtacggaaccggcctggacgaggcgacgacgacggctggtgtacttcgtggttgcgagacgcccccatcgggaggctacgngggttgggngccgttaacgg

SEQ ID NO: 398208 - DNA, 749 bp, Homo sapiens
  misc_feature: GZ8MTXP01EOJE8.38.4.A04.1.454.CMB.2.raw
  modified_base (267)..(267): a, c, t, g, unknown or other
  modified_base (312)..(312): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaggtgtccagtgtgaggtgcaacgtggtggagtcgtgggggaggcttgggtccgagggcccgggggggtccctggagactctcctgtgcagcctntgctattctaccttagtaacttatttaagtgagcgtcgggtcccnccgacgcccgtaccggaagggggaacgggggtcgtaggggagggttgggggtcggaccgagactaacttaaaccgaagtagtacggaacgtaaagaaaaattctaagtgtaggctcgtaggtagggaacggggtccgtaagttccgacctacttccgtaccgaagacgaaccaaacccgaccgaaacgtaacctaccgaacgttggtcggaccttaggacctaacgtaacggttaaccgggaaaccgggtcccgtaagggaacgggacggggaaccggaaaccggaaccggtaaccggggtccgtttgggttaacggttttaacccgttttgtacggggttcggacccgggaacggttacccccggcccccgttaaggtcggggaacgggtaaccgttaacgggagggttacggggtaacgttccgtttaaaccggg

SEQ ID NO: 398209 - DNA, 559 bp, Homo sapiens
  misc_feature: GZ8MTXP01D30KK.38.4.A04.1.454.CMB.2.raw
  modified_base (279)..(279): a, c, t, g, unknown or other
  modified_base (284)..(284): a, c, t, g, unknown or other
  modified_base (292)..(292): a, c, t, g, unknown or other
  modified_base (307)..(307): a, c, t, g, unknown or other
  modified_base (373)..(373): a, c, t, g, unknown or other
  modified_base (498)..(498): a, c, t, g, unknown or other
  modified_base (539)..(539): a, c, t, g, unknown or other
  modified_base (545)..(545): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactnactgnggctgcanatgaacggctgaagnggcgacgacacggctgtgtactttctgtgcgagacgccccccatggagggctaacgaggtgggaanctacgactttgactacgtgggggccagggaccctggtcaccgtctcctcacgcctccaccgaacgggcccatcggtccttccccgtcggccacccctcctccaagcgcacctcgtgggggcacgngcggcccgttggggcttcgcctggttcacggactaactccncgtcgnttcgcgttggaagg

SEQ ID NO: 398210 - DNA, 632 bp, Homo sapiens
  misc_feature: GZ8MTXP01ALGE0.38.4.A04.1.454.CMB.2.raw
  modified_base (281)..(281): a, c, t, g, unknown or other
  modified_base (313)..(313): a, c, t, g, unknown or other
  modified_base (360)..(360): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccattcgccatctcagagacaacgcaagactcatgngctgcacatgaacggctggagaggcgacgacncggctgtgtacttctgtgcgagccgcccccagtggagggtctaacgngggtagggatccgtaacggtactttggaccttacgggtgggggacccaacgggacccgtcggtccgtaccgtcctcctcgacgccctccaccgaacggccctacgtccggttcccgttccccggtcggaccctacccctccctacccgaacgaccgccaccgtccggtcgggggccaccgcggcccggtccgttcgggccgttcgtccgtcgggttacgacggttaccttaaccgttccgtaacgtcgacgttccgtaacgttcggaacggg

SEQ ID NO: 398211 - DNA, 580 bp, Homo sapiens
  misc_feature: GZ8MTXP01B3HI0.38.4.A04.1.454.CMB.2.raw
  modified_base (282)..(282): a, c, t, g, unknown or other
  modified_base (361)..(361): a, c, t, g, unknown or other
  modified_base (368)..(368): a, c, t, g, unknown or other
  modified_base (385)..(385): a, c, t, g, unknown or other
  modified_base (496)..(496): a, c, t, g, unknown or other
tcagtcgatcacgtcacgaccggtgctcgatttagagtagtgatcaggggaagaccgatgggcccttggggaggcttggtccagccggggggtccctgagactctcctgtgcagcctctgcattcacctttagtaactatttaatgagctgggtccaccagcctccagggaaggggctggagtgggtggccagcattaaccaagatggacgtgaaaaatactatgtggactctgtgaagggccgattcgccatctccagagacaacgccaagaactcactgnggctgcacatgaacggcctgagaggcgacggcacggctgtgtactttctgtgcgagacgccccccatggagggctacgngtggganctagactttgactacgnggggccagggaccctggcaccgtctcctcacgcctccaccaacggcccagtccgtccttcccccggtcggcctacccctcctacccaacgacgccacctcgtcgggggccncgacgccggcccgttcgggcgttcgcccgtgggttccgacggttacctaacttccgaacgttgacttcgtaacgttggaacggg

SEQ ID NO: 398212 - DNA, 586 bp, Homo sapiens
  misc_feature: GZ8MTXP01DDSXZ.38.4.A04.1.454.CMB.2.raw
  modified_base (284)..(284): a, c, t, g, unknown or other
  modified_base (296)..(296): a, c, t, g, unknown or other
  modified_base (541)..(541): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtgggggagcttggtccgaggccggggggtccctgagactctcctgtgcagcctctgcattcacctttagaactatttaangagcgtggtccncagcctccgagggagggctggagtgggtgccagcattaaccaagataggaaccgtagaaaaatcgtaatggtaacggactcgtgtagggaaacgggccgtaattccggacctatcctaccgaagaacgaacaaacgaccaaagaacctacaacgtgtcggctgacaacgagtacggaaccgccgtagaggacggcgaacgacgaacggtctgtgtaacttcgttggtcgcgaacgccgcccccgngttcggaaggccgtaacgagggtgggacgtcgttaacgttaaccg

SEQ ID NO: 398213 - DNA, 542 bp, Homo sapiens
  misc_feature: GZ8MTXP01BWY1H.38.4.A04.1.454.CMB.2.raw
  modified_base (292)..(292): a, c, t, g, unknown or other
  modified_base (305)..(305): a, c, t, g, unknown or other
  modified_base (347)..(347): a, c, t, g, unknown or other
  modified_base (360)..(360): a, c, t, g, unknown or other
  modified_base (370)..(370): a, c, t, g, unknown or other
  modified_base (390)..(390): a, c, t, g, unknown or other
  modified_base (460)..(460): a, c, t, g, unknown or other
  modified_base (478)..(478): a, c, t, g, unknown or other
tcagtcgatcacgtcacgaccggtgctcgatttagagtagtgatcaggggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccgagggccgggggggtccctggagactctcctgtgcagcctctgcattcacctttagaactatttaangagcgtgggtccncagcctccgagggagggctggagtgggtgccagcataacagntggactagaaatnatgtagactngtagacgggcattcgcatcncagagacacgacaagactacactgtacggctagacacgagtacggaacggcctggacgaggccgacgacncgactggtctaacttcgngtcgcgacgccgccccgacgttggaacgggactaacgagggtcgggacgtcgttaacgttaacg

SEQ ID NO: 398214 - DNA, 694 bp, Homo sapiens
  misc_feature: GZ8MTXP01ACVYJ.38.4.A04.1.454.CMB.2.raw
tcagtcgatcacgtcacgaccggtgctcgatttagagtagtgatcagggggagtcagtcccagtcaggacacagcatggacatgagggtccccgctcagctcccggggctcctgctgctctggctcccaggtgccggatgtgacatccagttggcccagtctccatccttcctgtctgcatctggtagggacagagtcaccatcacttgccgggccagtcgagggctattaggacttcgttagcctggtatcaagacaaaaaccgagggaaacgcccctaacctcctgatctatggtgcatcctattttcgactaaaggtcggggtaccccaagtacgaaaggttcaaggcggactaggtggatcgtaggggaactaaaggtaacttcgagtcctacaacaatcagccaggcctgacaacgggtcccgtagggaacgacttaacgtacggtaaccttaaaacttttaacgtttaatttcggtaaccttaaacgtaaacggtttacctttaaaaccggttaaccccgtttaaaccccccaacgtttaccggtttttacggggacccggttaacgggggtaaccctaaagggtttgggaactaaacgttaccgtaaaacggttaaccgttggtaggccttcgaccctaaccctgttccttcggttaccttaccgtaacctttccccgttaaccccg

SEQ ID NO: 398215 - DNA, 682 bp, Homo sapiens
  misc_feature: GZ8MTXP01B45W3.38.4.A04.1.454.CMB.2.raw
  modified_base (285)..(285): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaaatctatgtggactctgtgaagggccgattcgccatctccagagacaacgcaagaactcactgnggctgcacatgaacggcctgagaggcgacgacacggctgtgtactttcgtgtcgacgagaccgccccccagtcggagggtcctaacgaggtaggggactccgttaacgtacttttaggaacctacgggtcgggggacccaaacggggtaaccccgttgggtacccctaccggtcctccctacgaccgccctacccaaccgaaccgggcccctacgtcccggttccccttcccccgggtcggtccctacccccgtcctacccgaaacgaccgcccgacccgtcggtcgggggaccaccggacggcccgggtcccgttggggccttcggcccgtgggttaccgaacggttccttaaccgtcccgttcgtacggtcttacggaacgttcggtaaccgggg

SEQ ID NO: 398216 - DNA, 581 bp, Homo sapiens
  misc_feature: GZ8MTXP01DNTU8.38.4.A04.1.454.CMB.2.raw
  modified_base (278)..(278): a, c, t, g, unknown or other
  modified_base (358)..(358): a, c, t, g, unknown or other
  modified_base (495)..(495): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaaggccattcgcatctcagagacaacgcaagactcactgngctgcacatgaacggctgagaggcgacgacacggctgtgtacttctgtgcgagcgcccccatggaggctacgagtgggancgtacgactttgactacgtggggccagggaccctggccaccgtctcctcacgccctccaccaacgggccccagtccggttcccttcccccggtcggcctacccctcctcccaagcgccacctcgtcgggggcaccgnggccggcccttgggggcttcggcccgttgggttccgaacggaccttaaccgttccaacggttcgacgttcgtaacgttggaacggg

SEQ ID NO: 398217 - DNA, 609 bp, Homo sapiens
  misc_feature: GZ8MTXP01BSXR5.38.4.A04.1.454.CMB.2.raw
  modified_base (285)..(285): a, c, t, g, unknown or other
  modified_base (293)..(293): a, c, t, g, unknown or other
  modified_base (308)..(308): a, c, t, g, unknown or other
  modified_base (374)..(374): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccattcgccatctccagagacaacgccaagaactcactgnggctgcanatgaacggcctgagnggcgacgacacggctgtgtacttctgtgcgagacgccccccagtggagggctacgaggtagggacncgtacgtactttgaccgtacggtcggggccgaacgggaccctggtaccaccgtctcctcgacgccctccaccgaacgggcccacgtccgtcccttccccggtcggcccacccctccctaccaacgcgccaccgtcgtcggggccacgcggccggccgttcgggcttcggccgtcgggttaccgaacgggttccttaaccgttcccgaacggttgacgttcgtccgttgggccggg

SEQ ID NO: 398218 - DNA, 572 bp, Homo sapiens
  misc_feature: GZ8MTXP01BQN0R.38.4.A04.1.454.CMB.2.raw
  modified_base (286)..(286): a, c, t, g, unknown or other
  modified_base (366)..(366): a, c, t, g, unknown or other
  modified_base (375)..(375): a, c, t, g, unknown or other
  modified_base (552)..(552): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcaccttttagtaactatttaatgagctgggtccgccagcctccgagggaaggggctggagtgggtggccagcattaaccaagatggacgtagaaaaatctatgtggactctgtgaagggccattcgcatctccagagacaacgccaaagactcactgnggctgcaacatgaacggctgagaggcgacgacacggctgtcgtactttctgtgcgagacgcccccagtggagggctacgnggtgggacnctacgtactttgactacgtgggggccaacgggaccctgtcaccgtctcctcacgcctccaccgaacggcccagtccgttcccttccccgtcggcccaccctccctaccaacgacgcaccgtcgtcggggcacgcgccggccgttggccttcgccgtggcgaggacctcttccgcgtnacgttcgaacgttggaacgg

SEQ ID NO: 398219 - DNA, 624 bp, Homo sapiens
  misc_feature: GZ8MTXP01AK6QC.38.4.A04.1.454.CMB.2.raw
  modified_base (242)..(242): a, c, t, g, unknown or other
  modified_base (269)..(269): a, c, t, g, unknown or other
  modified_base (290)..(290): a, c, t, g, unknown or other
  modified_base (370)..(370): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcaccttttagtaactatttaatgagctgggtccgccagcctccgaggggaaggggctgggagtgggtggccagcattaaccaagatggaacgtagaaaaaatctatgtggactntgtgaagggccattcgcatctccaganacaacgccaaagactcactgnggctgcacatgaacggctgagaggcgaacgacacggctgtcgtacttcgtgtgcgagccgcccccagtggagggctacgnggtgggactctacgtactttgacctacggtcgggggaccaacgggaacccgtggtccgtaccgtcctcctcaccgccctaccgacccgaacggccctacgtcccgttcccttcccccggtcggccctacccctccctaccgaacgacgccgaccgtcgtcgggggccacgcggcccggcccgttcgggccttcggtccgtcggttacgaacggttacctaacgtcgtccgacggtcgacgtcggaacgtcgggg

SEQ ID NO: 398220 - DNA, 629 bp, Homo sapiens
  misc_feature: GZ8MTXP01EJNAM.38.4.A04.1.454.CMB.2.raw
  modified_base (286)..(286): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgnggctgcacatgaacggcctgagaggcgacggcacggctgtgtacttctgtgcgagacgcccccatggaggctacagtggganctacgacttgactacgtggggccagggaccctggtcaccgtctcctcacgccctccaccgaacggccccatccggtcccttcccccggtcggccctaccccgtcctaccaacgacgccacccgtcgtcgggggccaaccgcggcccgggcccccgttgggggcccttcggccccgttgggttacccgttaaacggggttacccttaacccgtttcccgaaccgggttggacgttacccggaaccgttgggtaacccggggg

SEQ ID NO: 398221 - DNA, 655 bp, Homo sapiens
  misc_feature: GZ8MTXP01DGZ28.38.4.A04.1.454.CMB.2.raw
  modified_base (263)..(263): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccgaggcccggggggtccctgagactctcctgtgcagcctntgctattcacctttagtaacttatttaatgagtcgtcgggtcccgcacgccgtccgaggggaaggggctgggaggtggggtggcccagacagttaaaccaaggataggaaccgtaaggaaaaatctaagtgtacggactcgtaggtaggaaacggggccgtaattccgactactccgtaccaagaacgaaccaaacgaccaaagaacctcaacgtgtgctagccaacgagtacggaaccggcctaggacggacggaccggaacgaccgtacgggtctggttcgttaaccgtgttcggtcggcggtaaacggcccgaccccccgttaggttacggggaacggggaccttaacggaacggggttcggggaacgtccggttaaccggttaaccgg

SEQ ID NO: 398222 - DNA, 588 bp, Homo sapiens
  misc_feature: GZ8MTXP01APDMU.38.4.A04.1.454.CMB.2.raw
  modified_base (284)..(284): a, c, t, g, unknown or other
  modified_base (368)..(368): a, c, t, g, unknown or other
  modified_base (415)..(415): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgnggctgcacatgaacggcctgagaggcgacgacacggctgtgtacttctgtgcgagacgcccccactggagggctacagtggganctacgactttgactacgtggggccagggaccctggtcaccgtctccncagcctcaccaagggcccatccggtcctccccgtggccaccctccctccaagacgccaccctcgtcgggggccaccgacggccggccccgttgggggccttcggccccgttggggttacccaaagggaccctaacgttcccaacggttcggacttcgaaccgttgggaacggg

SEQ ID NO: 398223 - DNA, 529 bp, Homo sapiens
  misc_feature: GZ8MTXP01AWOQG.38.4.A04.1.454.CMB.2.raw
  modified_base (255)..(255): a, c, t, g, unknown or other
  modified_base (270)..(270): a, c, t, g, unknown or other
  modified_base (292)..(292): a, c, t, g, unknown or other
  modified_base (318)..(318): a, c, t, g, unknown or other
  modified_base (362)..(362): a, c, t, g, unknown or other
  modified_base (425)..(425): a, c, t, g, unknown or other
  modified_base (470)..(470): a, c, t, g, unknown or other
  modified_base (487)..(487): a, c, t, g, unknown or other
  modified_base (508)..(508): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtgctatttagaaggtgtcagtgtgaggtgcaacgtggtggagtcgtgggggagcttggtccgaggccggggggtcctggagactctcctgtgcagcctcngcattcaccgtttanaactattaatgagcgtggtccncagcctcgagggaggctggagtgggngccagctaataacgagatggacctagaaaatctatgtagactgngtaggaacggcctatcgcatcacgagagacaacgcaaacgactcacgttgcgctgaccagganaggaaccgcgtaggagagcgacgtacgaccgtgtgtgtaacttgngtcgcgacgcccgccgngcggaacggtcaacggtcggnggacgtaacgttaacgtaacg

SEQ ID NO: 398224 - DNA, 554 bp, Homo sapiens
  misc_feature: GZ8MTXP01D40X4.38.4.A04.1.454.CMB.2.raw
  modified_base (296)..(296): a, c, t, g, unknown or other
  modified_base (346)..(346): a, c, t, g, unknown or other
  modified_base (363)..(363): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattgggctgagctgggtttcctgttgctattttagaaggtgtccagtgtgaggtgcaactggtggagtcgtgggggaggcttggtccaggccggggggtcctgagctctcctgtgcagcctctgctattcaccttagtaactatttaatgagcgtgggtccncagcctcgaggggagggctggagtgggtgcagcataacagatcgacgtanaaaatctatgtgaactntgtgaagggccgattccgacatctaccagacgaacaacgaccaaagaactcacgtgtcggactgactaacgagtacggaaacggtcctaggaggacggaccgacgtaccgacggctaggtgttacttcgtgttcgcgacgaccgcccccagtggacggggtctacggagggttcgggaacgttccgtaacg

SEQ ID NO: 398225 - DNA, 543 bp, Homo sapiens
  misc_feature: GZ8MTXP01AF3R3.38.4.A04.1.454.CMB.2.raw
  modified_base (296)..(296): a, c, t, g, unknown or other
  modified_base (338)..(338): a, c, t, g, unknown or other
  modified_base (502)..(502): a, c, t, g, unknown or other
  modified_base (521)..(521): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagaactattaatgagctgggtccnccagcctcgagggagggctggagtgggtgcagcattaacagntggaccgtagaaaatctatgtgactctgtagagggcattcgcatctcagacgacaacgaccaaagactcactgtacgctgcacgtagtaggtaaccggcctaggacggacgggaccgtaacgacgtacgggctggtgtaactcgttggtgcgagccgcccccgngttcggaacgggtcaacgnggtgggactcgttaacgtaacg

SEQ ID NO: 398226 - DNA, 610 bp, Homo sapiens
  misc_feature: GZ8MTXP01BIJKW.38.4.A04.1.454.CMB.2.raw
  modified_base (239)..(239): a, c, t, g, unknown or other
  modified_base (283)..(283): a, c, t, g, unknown or other
  modified_base (325)..(325): a, c, t, g, unknown or other
  modified_base (547)..(547): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcacctttagtaactatttaatgagctgggtccgccagcctccgagggaaggggctgggaggtgggtggccagcaattaaccaagatggacgtagaaaaatctatgtgactntgtgaaggccatcgcatctcagagacaacgcaagaactcactgngctgcacatgaacggctggagaggcgacgacacgggctggtntactttcgtgtgcgagccgcccccagtcggaggctaacgaggtgggactcgtacgtactttgacgtacgtcgggggacctacgggaaccctggtccaccgtcctcctcaccgccctaccgaacccgacgggcccacgtccggttccccttccccggtacggccctacccctccctaccaacgcgcacccgtcgtggggccacgcggcccggccgttcgggcncgtccgtggttccgaacggttacctaacttcccgaacgttcgacgttcgaacgttcggaaggg

SEQ ID NO: 398227 - DNA, 609 bp, Homo sapiens
  misc_feature: GZ8MTXP01DJVVX.38.4.A04.1.454.CMB.2.raw
  modified_base (470)..(470): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtggggggaggcttgggtccagggcccgggggggtccctggagactctcctgtgcagccctctgctattctacctttaagtaaacttatttaatgagcgtgggtcccgcacgccctcgaggggaaggggcgtgggaggtgggggtgcccagcaattaaaccaagataggaaccgtaagaaaaatctatggtaggactcgtaggtggaaacggggcctattccgcctatcctaccaagacgaacaacgaccaaagaactcacgtgnggctagacacgacgtacggaaccggcgtagaggacggcgaaccgacgacggtctgtgttaacttcgttggtcgcgacgaccgcccccgacgttacgggaacgggactaacgacgggtggggacgtcgttaacgttaacg

SEQ ID NO: 398228 - DNA, 545 bp, Homo sapiens
  misc_feature: GZ8MTXP01CKC73.38.4.A04.1.454.CMB.2.raw
  modified_base (377)..(377): a, c, t, g, unknown or other
  modified_base (502)..(502): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctggggggaggcttggtccaggccgggggggtccctgagactctcctgtgcagcctctgcattcacctttagtaactatttaatgagctgggtcccgcagcctccgaggggaggggctggagtgggttgccagcattaaccaagatggaccgtagaaaatctatgtaggactcngtgaagggccgattcgcatctcagagacaacgccaaagactcactgtggctgcacgagtaggaaccggctggagacggacgacgacgacggctggtgtaacttcttggtgcggacgcgcccccgngttcggaacgggctaacgaggtcgggagtccgttaacgtaacg

SEQ ID NO: 398229 - DNA, 548 bp, Homo sapiens
  misc_feature: GZ8MTXP01BQE1Q.38.4.A04.1.454.CMB.2.raw
  modified_base (508)..(508): a, c, t, g, unknown or other
  modified_base (526)..(526): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcgttgggtccgagggcccgggggggtccctggagactctcctgtgcagccctctgcattcacctttagaactatttaatgagctgggtccgccagccctccgagggaggggctggagtgggtgccagcattaaccaagagtggaccgtagaaaatctatgtagactcgtgtgaagggccattcgctatctcagagacaacgcaaagactcactgtgctgcacgagtgaaccggcctaggagacggcgacgacgacgggctgtgtaacttcgttgtcgcgacgccgcccccgngttcggaagggctaacgnggtgggatcgttaacgtaaccg

SEQ ID NO: 398230 - DNA, 593 bp, Homo sapiens
  misc_feature: GZ8MTXP01D5F56.38.4.A04.1.454.CMB.2.raw
  modified_base (285)..(285): a, c, t, g, unknown or other
  modified_base (297)..(297): a, c, t, g, unknown or other
  modified_base (537)..(537): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccagggccgggggggtccctgagactctcctgtgcagcctctgcattcacctttagaactattaangagctgggtccncagcctcgagggagggctggagtgggtgccagcaattaaccagatggacgtagaaaaatactatgtagacttcgtgtaggaacggggtccgaattcccggactaactcctacccaaggaacgaacaaaccgaccaaagaacctacacttgcggctagcaacgatcggaaaccgccgtagaagacggcgaaccgcgaacgggtctagtgtaacttcttggtcgcgaacgaccgccccccgngttacgggaacgggtctaaccggagggttcggggacgtccgttaaccggttaacgg

SEQ ID NO: 398231 - DNA, 663 bp, Homo sapiens
  misc_feature: GZ8MTXP01BNJ41.38.4.A04.1.454.CMB.2.raw
  modified_base (257)..(257): a, c, t, g, unknown or other
  modified_base (283)..(283): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaagggctggagtgggtgccagcaattaaccaagatggacgtagaaaaatctatgtggactctgtgaagggccattcgcatcncagagacaacgcaaagaactcactgnggctgcacagtgaaccggctggaagaggaccgaacgacgacggtctgtcgttacctttcgtggtcgcgaacgaccgccccccagtcgggacggtctaacgagggtgggactcgtaacgtacgtttggaccgttaccggtcggggggacctaacggggtaacccgttcggtcctacccgtcctccctcgaccgtccctacccaaccgaaccgggcccctacgtccggttccccttcccccggtcggcccctacccctcccgtaccgaacgacgccgtaccgtcgtcgggggaccacgacggcccggccgttcgggcttcggtccgtggttaccgacggttactaacctccgaacgtcgacgttccgtaacgttggaacggg

SEQ ID NO: 398232 - DNA, 553 bp, Homo sapiens
  misc_feature: GZ8MTXP01CK0YO.38.4.A04.1.454.CMB.2.raw
  modified_base (293)..(293): a, c, t, g, unknown or other
  modified_base (304)..(304): a, c, t, g, unknown or other
  modified_base (387)..(387): a, c, t, g, unknown or other
  modified_base (467)..(467): a, c, t, g, unknown or other
  modified_base (499)..(499): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcttgggtccgaggccggggggtccctgagactctcctgtgcagccctctgcattcaccttttagaactatttaatgancgtgggtcccncagccctccgagggaaggggctggacgtggggtggcccagcattaaccaagagtggaccgtagaaaaatctatgtaggactcngtggaagggccgattcggccatctccagacgacaacgacaagaactcactggtagctgacacgataggaacgccgtgagnggcgacgacacgggcctagttcgtaacttcgngtgcgagcgccccgcgttggaacggctaacgaggtgggactcgttaacgtaacg

SEQ ID NO: 398233 - DNA, 609 bp, Homo sapiens
  misc_feature: GZ8MTXP01BOHNN.38.4.A04.1.454.CMB.2.raw
  modified_base (394)..(394): a, c, t, g, unknown or other
  modified_base (577)..(577): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatcgtgtaggggacagagtcaccatcacttgccgggccagtcgagggcattaggacttcgttagcctggtatcagacaaaaaccgagggaaacgcccctaaacctcctgatctagtggtgcatcctattttgacgtaaaggtcgggggtacccaagtctaaaggttcaggcggccgaggtggatcgtagggaacagtaatcagtctcacatcgancagcctgcagccgtagagatactacgtataactttaattattcggtactaacgtacgtactttaaacgtaccgttaccccctaacttaccgttttcgggaccggtaacggggtaaccgttaaagggttaaggaagttaacgtaacgaaacggtaaccgtgggttacgcgttcggaactacctnttaccgttcgttccttcgttaacgtttccccg

SEQ ID NO: 398234 - DNA, 582 bp, Homo sapiens
  misc_feature: GZ8MTXP01BJRMU.38.4.A04.1.454.CMB.2.raw
  modified_base (257)..(257): a, c, t, g, unknown or other
  modified_base (292)..(292): a, c, t, g, unknown or other
  modified_base (533)..(533): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgagtgcaactggtggagtcgtgggggagcttggtccaggccggggggtcctgagactctcctgtgcagcctcngcattcacctttagaactattaatgagctggtccnccagccctcgagggaagggctggagtgggtgccaggcaagttaaccaagagtggaaccgtagaaaaaatctaatggtaggactcgtgtaggaacgggcctaattccgctaatctaccaagacgaaccaacgaccaaacgaacctacaacgtgtacgctagcctaacgatacggaaaccgcctaggagacggacgaccgacgaccggctcgtgtaactcgttgtcgacgacgacgcccccgngttacgggaagggcctaacgaggtcgggacgtccgttaacgttaaccgg

SEQ ID NO: 398235 - DNA, 691 bp, Homo sapiens
  misc_feature: GZ8MTXP01C50M3.38.4.A04.1.454.CMB.2.raw
  modified_base (289)..(289): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttggtccgaggcccgggggggtccctggagactctcctgtgcagcctctgcattcacctttagaactattaangagcgtggtccgcagccctcgagggaagggctggagtgggtgccagctattaaaccaagatggaaccgtagaaaaatctagtgtacgggactcgtagtacgggaaagggtcccgtaattccggaccctaatccctacccgaaggacggaaccaaaccggacccaaaagtaacctcaaccgtggttacggctaggaccaacgaagttacggaaaccgggtcccgtaggaacgggaacgggtaccggaaaccggaccgtaaccgggtaccgttgggttacgtttaaccgtttccgttggttcggaccggtaaacgaccccggacccccccgttaggttacgggaacgggggtaccccttaacggaacggggttggggaaccgtccgttaacccggtttaaccgg

SEQ ID NO: 398236 - DNA, 538 bp, Homo sapiens
  misc_feature: GZ8MTXP01C19U0.38.4.A04.1.454.CMB.2.raw
  modified_base (451)..(451): a, c, t, g, unknown or other
  modified_base (498)..(498): a, c, t, g, unknown or other
  modified_base (516)..(516): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccaggccggggggtccctgagactctcctgtgcagcctctgcattctacctttagaactatttaatgagctggtccgcagcctcgagggagggctggagtgggtgccagcattaacagatggaccgtagaaaatctatgtaggactcgtgtaggaacgggtccgattcggcctatcctaccgagacgacaacgaccaagactcactgtgctgcagatgaacgctagacgnggccgacgacgcggactggtgtaacttcgttgtgcgacgcgccccgngttcggaacggctaacgnggtgggactcgttaacgtaacg

SEQ ID NO: 398237 - DNA, 608 bp, Homo sapiens
  misc_feature: GZ8MTXP01A3HI1.38.4.A04.1.454.CMB.2.raw
  modified_base (307)..(307): a, c, t, g, unknown or other
  modified_base (559)..(559): a, c, t, g, unknown or other
  modified_base (580)..(580): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcttgggtccgagggcccggggggtccctgacgactctcctgtcgcagcctctgctattcacctttagaacttattaatgagcgtggtcccncagcctcgaggggaggggctgggagtgggtgccagcaattaaccgaagagtaggaaccgtaagaaaaatctaagtggtaagactcgtggtaggaaacgggtccaattccgacctatcctacagacgaacaaccgacaaagactcacgtgtacgctgaccaacgagtacggaaccgccgtaggacggacgggaccgaacgacgtacggtctcggtcgttaacttcgttggtcgcgaacggccccgacccccgngttcgggaacgggtctaacgngggtcgggacgtcgttaacggttaaccg

SEQ ID NO: 398238 - DNA, 629 bp, Homo sapiens
  misc_feature: GZ8MTXP01BG3SE.38.4.A04.1.454.CMB.2.raw
  modified_base (272)..(272): a, c, t, g, unknown or other
  modified_base (318)..(318): a, c, t, g, unknown or other
  modified_base (562)..(562): a, c, t, g, unknown or other
  modified_base (582)..(582): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggaggtcgttgggtccgagggcccgggggggtccctggacgactctcctgtgcagcctntgctattctacctttaagtaacttatttaatgagcgtcgggtcccnccagccctccggaggggaggggctgggaggtggggtgcccagctaattaaccaagagtggaaccgtaagaaaaatcgtagtggtacgggacttcgtaggtacgggaacgggtcccgtaagttccgactacgtcctaccgaagacgaccaacgaccaaacgacctcacgtgtcgactgaccaacgagtcggaaaccgggcctaggacggacggccgaacgacgacgggtcttggtgtaacttcgngtcgacgacgcccgccccgngttggaacgggtctaacggagggtggactaaccgttaacgttaaccg

SEQ ID NO: 398239 - DNA, 564 bp, Homo sapiens
  misc_feature: GZ8MTXP01DP4WY.38.4.A04.1.454.CMB.2.raw
  modified_base (332)..(332): a, c, t, g, unknown or other
  modified_base (369)..(369): a, c, t, g, unknown or other
  modified_base (500)..(500): a, c, t, g, unknown or other
  modified_base (548)..(548): a, c, t, g, unknown or other
  modified_base (552)..(552): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcaccttttagtaactatttaatgagctgggtccgccagcctccagggaagggctggagtgggtggccagcattaaccaagatggacgtgaaaaatctatgtggactctgtgaagggccattcgccatctcagagacaaacgccaaagaactcactgtggctgcacatgaacggctgagaggcgacgacacggctgtcgtactttcnggtgcgagcgcccccatggagggctacgaggtgggancgtacgacttttgactacgtgggggcccaagggaaccctggtccaccgtctcctcacgcctaccaccgaacggcccagtccgtcccttccccgcggcccaccctcctccaagcgccacctcggtcggggcncgagccggccgttgggcttcggcctggacacggactaactccaacgtntacngtaacgttgcgg

SEQ ID NO: 398240 - DNA, 651 bp, Homo sapiens
  misc_feature: GZ8MTXP01CSXI3.38.4.A04.1.454.CMB.2.raw
  modified_base (280)..(280): a, c, t, g, unknown or other
  modified_base (337)..(337): a, c, t, g, unknown or other
  modified_base (377)..(377): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtgccagcattaaccaagatggaacgtagaaaaaatctatgtgactctgtgaaggcattcgcatctcagagacaacgccaagaactcactgnggctgcacagtacgaaccggcctaggagaggcgaacgacacggctgtgttacttcgngtgcgagccgcccccagtggagggctaacgaggtgggacnccgtacgtactttacgaccgtaacggtcgggggacccaaacgggtaacccgttcggtacccgtacccggtcctcccgtaccgacgtccccgtacccgaacccgaacgggccccacgttcccggttccccttcccccggtccggtacccctaccccttccctaccgaaccgaccgccctacccgtcgtcggggcacgcggccggccgttcgggcttcgtccgtggttacgacggttacctaactccgaacgtcgacttcgtaacgttggaacggg

SEQ ID NO: 398241 - DNA, 581 bp, Homo sapiens
  misc_feature: GZ8MTXP01BV7U6.38.4.A04.1.454.CMB.2.raw
  modified_base (284)..(284): a, c, t, g, unknown or other
  modified_base (329)..(329): a, c, t, g, unknown or other
  modified_base (511)..(511): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccattcgccatctccagagacaacgccaagactcactgngctgcacatgaacggcctgagaggcacgacacggctgtgtacttntgtgcgagcgccccccatggagggctacgaggtgggagctacgtactttgacgtacgtgggggccacggggaaccctggtccaccgtcctccctcacgccctccacccgaacgggccccagtccgtcccttcccccgtggcccaccccgtcctccaacgcgccacccgtcggtcggggaccncgcggcccggccgttgggcttcgccgtgttcgacgccttaacctccgaacgttcgattccgcgttggcgg

SEQ ID NO: 398242 - DNA, 655 bp, Homo sapiens
  misc_feature: GZ8MTXP01C8364.38.4.A04.1.454.CMB.2.raw
  modified_base (322)..(322): a, c, t, g, unknown or other
  modified_base (330)..(330): a, c, t, g, unknown or other
  modified_base (339)..(339): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccgagggaaggggctggagtgggtggccagcattaaccaagatggacgtgaaaaaatctatgtggactctgtgaaggccattcgccatctcagagacaacgcaagaactcactgtggctgcacatgaacggctgagaggcacgacacggctgtntactttcngtgcgagcncccccagtggagggctacgaggtgggactccgtacgtactttgaaccgtacggtcgggggaccgaacgggtaaccccgttcggtaccgtaccgtcctccctaccacgccctaccgaccgaacggcccacgttccggttccccttccccggtcggtccctaccccgtaccctacccgaaacgcggaccctacccgtccggtcgggggaccacggcggtcccgggcccgttcggggccttacggtcccgtcgggttaccgaaacgggttaccttaaccttaccgaacggttacgacgttcgaaccgttggaaccgggg

SEQ ID NO: 398243 - DNA, 615 bp, Homo sapiens
  misc_feature: GZ8MTXP01AHFSO.38.4.A04.1.454.CMB.2.raw
  modified_base (268)..(268): a, c, t, g, unknown or other
  modified_base (289)..(289): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggacttcgttagcctggtatcagacaaaaccgagggaacncccctaactctgatctattgngctatcctattttgacgtaaaggtcgggtacccagtacgaaggttcaggccggctaggtggatcgtagggaaactagtaacttcacgtctacaacatcaacgcgacgcctgacgagccgtaggatacgtactgaccttaattatttatcggtactaacgtagtaactttaaccgttaccgttaacccctacgttaccgtttcgggacccgtaagggtaacctaaggttcggaacgacgttaaaccgaaaacggtaacgtcggttacggcttaccggaacctaccgttaactttaccggtctttacccttcgttaaccgtttccccg

SEQ ID NO: 398244 - DNA, 601 bp, Homo sapiens
  misc_feature: GZ8MTXP01DV3WB.38.4.A04.1.454.CMB.2.raw
  modified_base (258)..(258): a, c, t, g, unknown or other
  modified_base (294)..(294): a, c, t, g, unknown or other
tcagtcgatcacgtcacgaccggtgctcgatttagagtagtgatcaggggaggtctcagagaggagccttatccctggactccaaggcctttccacttggtgatcagcactgagcacagaggactcaccatggaattggggctgagctgggttttcctgttgctattttagaggtgtccagtgtgaggtgcaacgtggtggagtcgtgggggagcgttggtccgagggcccgggggggtccctgagactctccgtgtncagcctctgctattcaccttaagtaacttatttaangagcgtcggtccgcagcctcgaggggaggggctggagtgggtcgaccagctaacttaaaccgaagacgtaggacgtaaagaaaaatacgtatcgggtagaactgtaggtaggaacgggcgaattccgacctatctaccaagacgaacgaaaccgaaccgaaagaactcacgtagtcggctcgacaacgtagtacggaaaccggtccgtaggagacggaccgacgtaccgacggtcttggtcttacgttcgtggttgacgacgaccgcccccaagtggacggcctagaggttgggaacgttcgtaacg

SEQ ID NO: 398245 - DNA, 642 bp, Homo sapiens
  misc_feature: GZ8MTXP01EZXNN.38.4.A04.1.454.CMB.2.raw
  modified_base (282)..(282): a, c, t, g, unknown or other
  modified_base (327)..(327): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaaccaagatggacgtagaaaaatctatgtggactctgtgaagggccattcgcatctcagagacaacgcaaagactcactgngctgcacatgaacgctgagaggcgacgacgacggctgtgtacttntgtgcgagaccgcccccatggagggctacgaggtaggggactctacgtactttggaccttaccggtcgggggacccaacggggtaaccccttgggtacctacccgtcctccctcgacgccctaccgaaccgaacgggccccacgttccggttcccttccccggtcgaccctacccctcctaccgaaacgcgacctaccgtcggtcgggggccaccgcggcccgggtcccgttggggccttcgggcccgttgggttaccgaacgggttaccttaacccgtccgaacggttgacgttacgaaccgttgggaaccggg

SEQ ID NO: 398246 - DNA, 621 bp, Homo sapiens
  misc_feature: GZ8MTXP01ANXM6.38.4.A04.1.454.CMB.2.raw
  modified_base (362)..(362): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctacgagggaagggctggagtgggtggccagcattaaccaagatggacgtagaaaaatctatgtggactctgtgaagggccattcgccatctccagagacaacgccaagaactcactgtggctgcacatgaacggcctgagaggcgacgacacggctgtgtacttctgtgcgagacgccccccatggagggctacgnggtagggatctacgtactttgactacgtcggggccagggaccctggtccaccgtcctcctcgacgccctaccaccgaacgggccccagtccggtcccttcccccggtcggccctacccctccctaccaacgcgccaccgtccggtcgggggccaacgcgggcccggcccgttcgggggccttcggtcccgtcgggttaccgaacgggttacccttaaccgttccgaacgtacgacgttccggaacgttgggaaccgggg

SEQ ID NO: 398247 - DNA, 586 bp, Homo sapiens
  misc_feature: GZ8MTXP01DOHV7.38.4.A04.1.454.CMB.2.raw
  modified_base (286)..(286): a, c, t, g, unknown or other
  modified_base (297)..(297): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggccgggggggtccctgagactctccgtgtgcagcctctgcattcacctttagtaactattaangagctggtccncagcctcgagggagggctggagtgggtgccagcattaaccaagatggacgtagaaaaatctatgtagactcgtggtaggaacgggcctattccgacctatcctaccgagaacgaccaaaccggaccaaacgaacctcaaccgtgtcggctagacaacgacgtacggaaccgcctaggagacgggacgacgacgacggtctgtgtaacttcgttgtcggcgaacgacccgcccccgagttacgggaacgggctaaccggagggtgggacgtaaccgttaacggttaaccg

SEQ ID NO: 398248 - DNA, 555 bp, Homo sapiens
  misc_feature: GZ8MTXP01DF4H7.38.4.A04.1.454.CMB.2.raw
  modified_base (263)..(263): a, c, t, g, unknown or other
  modified_base (330)..(330): a, c, t, g, unknown or other
  modified_base (365)..(365): a, c, t, g, unknown or other
  modified_base (496)..(496): a, c, t, g, unknown or other
  modified_base (532)..(532): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctcaganacaacgcaagactcactgtggctgcacatgaacggctgagaggcgacgacacggctgtgtactttcngtgcgagcgcccccatggagggctacgagtggganctacgactttgactacgtggggccagggaccctggcacgtctcctcagccctcaaccgacgggcccagtccggtcccttccccgtcggccctacccctcctacccaagcgcacccgtcgtgggggccacgngccgccgttggggcttgccgtggttacaggctctcncgtgacttcgaacgttggaacgg

SEQ ID NO: 398249 - DNA, 533 bp, Homo sapiens
  misc_feature: GZ8MTXP01BNRWQ.38.4.A04.1.454.CMB.2.raw
  modified_base (256)..(256): a, c, t, g, unknown or other
  modified_base (258)..(258): a, c, t, g, unknown or other
  modified_base (263)..(263): a, c, t, g, unknown or other
  modified_base (298)..(298): a, c, t, g, unknown or other
  modified_base (326)..(326): a, c, t, g, unknown or other
  modified_base (340)..(340): a, c, t, g, unknown or other
  modified_base (488)..(488): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtggggggaggcttgggtccgaggccgggggggtcctgagactctcctgtncngcctngcattcactttagaactattaatgagctgggtccnccagcctcgagggagggctggagtgggngcagcataacaagntggactagaaaatctatgtagactcgtgtggaagggccattcgcatctacagagacaacgacaaagactcactgtgctgcacgatgaacggctggagaggcgacgacgacggtctgtgtaacttcgttggtcgcgacgccgcccccgngttcggaaggggctaacgagggtgggacgtaacgttaaccgtaag

SEQ ID NO: 398250 - DNA, 616 bp, Homo sapiens
  misc_feature: GZ8MTXP01ET4AE.38.4.A04.1.454.CMB.2.raw
  modified_base (271)..(271): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtcagtgtgaggtgcaactgggtggagtcggtggggggaggtcgttgggtccagggcccgggggggttccctgacgactctcctgtgcagcctngctattcacctttaagaacttatttaatgagcgtcgggtccgccagccctccggaggggaaggggctgggagtgggtgccagcattaacagagtaggacctagaaaatcgtagtgtagactcgtgtaggaacgggcctaagttccgactatctaccgagacgaaccgaacgaccaaagaacctcaacttggcgctgccaacgatacggaaccgcgtaggacgagaccgaacgtacgaccggtcttcggtcgttaacttcgttcggtcgccggaacgacccgccccccgttaggttacggaacgggtctaaccggagggtcgggacgtccgttaaccgtttaacgg

SEQ ID NO: 398251 - DNA, 564 bp, Homo sapiens
  misc_feature: GZ8MTXP01A7XVU.38.4.A04.1.454.CMB.2.raw
  modified_base (262)..(262): a, c, t, g, unknown or other
  modified_base (301)..(301): a, c, t, g, unknown or other
  modified_base (345)..(345): a, c, t, g, unknown or other
  modified_base (354)..(354): a, c, t, g, unknown or other
  modified_base (360)..(360): a, c, t, g, unknown or other
  modified_base (375)..(375): a, c, t, g, unknown or other
  modified_base (515)..(515): a, c, t, g, unknown or other
tcagtcgatcacgtcacgaccggtgctcgatttagagtagtgatcaggggggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtggggggagcgttggtccgagggccgggggggtcctgagactctcctgtgcagcctntgctattcacctttagaacttattaatgagcgtggtccncagcctcgagggaggggctggagtgggtgccagcattaacaagntggacctanaaaatntatgtaggactgtgnggaacgggcattcgcatctcaagacgacaacgacaaagtaactcactggtcgctcgacacgacgtaggaaacgccgtagacgaggcgaacggctacggcttggtcgtaacttcgttggtcgacggacgcccggacccccngttcgggaacggcgttaacgaagggtgggacgtccgttaacggtaaccg

SEQ ID NO: 398252 - DNA, 586 bp, Homo sapiens
  misc_feature: GZ8MTXP01AWBWD.38.4.A04.1.454.CMB.2.raw
  modified_base (259)..(259): a, c, t, g, unknown or other
  modified_base (279)..(279): a, c, t, g, unknown or other
  modified_base (316)..(316): a, c, t, g, unknown or other
  modified_base (361)..(361): a, c, t, g, unknown or other
  modified_base (370)..(370): a, c, t, g, unknown or other
  modified_base (515)..(515): a, c, t, g, unknown or other
  modified_base (518)..(518): a, c, t, g, unknown or other
  modified_base (528)..(528): a, c, t, g, unknown or other
  modified_base (582)..(582): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctcgagggagggctggagtgggtggccagcattaaccaagatggacgtagaaaaatctatgtggactctgtgaaggccgattcgccatctcaganacaacgcaagaactcactgnggctgcacatcgaacggcctgagaggcacgacacggntgtgtacttcgtggtgcgagtacgcccccagtggacgggctacgnggtagggancgtacgtactttggacttacggcggggaccacgggaaccctggtccaccgtctccgtcacgccctccaaccgaacgggcccagtccggttcccctccccgtcggccctaccctccctaccgaacgacgccaccgtcgtggggccncgngccggcccgngggccacggtccgtcgacgttaacggctaacctcgaacgtgacttcgtaaccgnggcg

SEQ ID NO: 398253 - DNA, 585 bp, Homo sapiens
  misc_feature: GZ8MTXP01BWW6H.38.4.A04.1.454.CMB.2.raw
  modified_base (286)..(286): a, c, t, g, unknown or other
  modified_base (498)..(498): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccaggggaaggggctggagtgggtggccagcattaaccaagatggacgtgaaaaatactatgtggactctgtgaagggccgattcgccatctccagagacaacgccaaagactcactgnggctgcacatgacggctgagaggcgacgacacggctgtgtacttctgtgcgagacgccccccagtggagggctacaggtgggagctacgactttgactacgtgggggccagggaccctggtcaccgtctcctcacgcctcccaccaacgggcccactccgtccttccccgtcggccacccctcctaccacgacgccaccgtcgtcgggggcncgacggccgggcccttcggggtcttcggccgtcggccgaacggacctaacttcccgaacgttcgacgttcgtaaccgttggaacggg

SEQ ID NO: 398254 - DNA, 703 bp, Homo sapiens
  misc_feature: GZ8MTXP01D6BRN.38.4.A04.1.454.CMB.2.raw
  modified_base (285)..(285): a, c, t, g, unknown or other
  modified_base (370)..(370): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcaccttttagtaactatttaatgagctgggtccgccagcctccgagggaaggggctggagtgggtggccagcaattaaccaagatggacgtagaaaaatctatgtggactctgtgaaggccgattcgcatctcagagacaacgcaaagactcactgnggctgcaacagtgaacggctgagaggcgaacgacacggctgtcgttacttctgtgcgacgaccgcccccagtggagggctaacgnggtacgggactcgtaacgtacgtttacgaacttaccgggtcgggggacccaaaccggggtaacccgttcggtacccgtaacccggtcctcccgtacgaacccgtccccgtacccgaaccccgaaacgggtccccctaacgttccccggttccccttccccccgggtcggtcccctaccccttcccgtaccaaacgaccgcctaacccgtcggtcgggggaccaccgacgggcccggtcccgttcggggtccttcggcccggttcggaccggttaaacggttaccctttaaccgtacccgtaacggtcgacgttccgaaccgttcggaacgggg

SEQ ID NO: 398255 - DNA, 560 bp, Homo sapiens
  misc_feature: GZ8MTXP01EEDQC.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtcagtgtgaggtgcaactggtggagtcgtgggggagcttggtccgaggccgggggggtccctgagactctcctgtgcagcctctgcattcaacctttagaactatttaatgagctgggtccgccagcctccgagggaggggctggagtgggtggccagcattaaccgaagatggaacctagaaaaaatctatgtaggactcgtgtgaaagggccattcgccatctccagacgaacaacgaccaaagaactcactgtggctgcacatggaaccgcctggagaggcgaacgacgacggctgtgtaacttcgttggtcgcgacggacgccccccgagttcggaacggggtctaacgagggtggggacgtaacgttaacggttaacg

SEQ ID NO: 398256 - DNA, 562 bp, Homo sapiens
  misc_feature: GZ8MTXP01DDREI.38.4.A04.1.454.CMB.2.raw
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccgaggccgggggggtccctggagactctcctgtgcagcctctgcattcacctttagtaactatttaatgagctgggtccncagcctccgagggaggggctggagtgggtgccagcattaaccaagatggaccgtagaaaaatctagtgtagggactcgtgtggaaaggggcctaattcgccatctcgagagacaacgaccaaagactcactgtagctgcacgatggaaccgccgtgagaggcgacgacgacggctggtgttaactcgttgtgcggacgccgcccccgagttcgggaacgggtactaacgagggtcgggacgtcgttaacggtttaaccg

SEQ ID NO: 398257 - DNA, 635 bp, Homo sapiens
  misc_feature: GZ8MTXP01AZHXX.38.4.A04.1.454.CMB.2.raw
  modified_base (263)..(263): a, c, t, g, unknown or other
  modified_base (289)..(289): a, c, t, g, unknown or other
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcggtgggggagcttgggtccagggccggggggtcctggagactctcctgtgcagcctngctattctacctttagaactattaangagtcgtgggtccnccacgccctcggaaggggagggctgggagtggggtcgccagctaattaaaccgaagtacgtaggaaccgttaaagaaaaaacttcgtagtggtaacggtactcggtaggtacgggaacggggtcctagttccggacctacgtcctaccgagaacgtaacaaccgaccaaagtactacaacgtgtcgactagaccacggtaagtcggaaccgcgtaggacgaggacgaccgacgacgggtctggtagtaacttcgttgacgcggacgacccgccccgttagttcgggaacgggactaaccggtagggcgggttactaacggttaacgttaacg

SEQ ID NO: 398258 - DNA, 633 bp, Homo sapiens
  misc_feature: GZ8MTXP01AVMDM.38.4.A04.1.454.CMB.2.raw
  modified_base (303)..(303): a, c, t, g, unknown or other
  modified_base (305)..(305): a, c, t, g, unknown or other
  modified_base (356)..(356): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcgttggtccgaggccggggggtcctgagactctcctgtcgcagcctctgctattctacctttagtaacttattatgagctcggtccncngcctacgagggagggctgggagtggggtcgccgagctaacttaaccgaagngtaggaaccgtaaggaaaaattcgtaatgtaggaacttcgtagtggaaacgggcccgtattccggacctactccgtaccagaacgaaccaaccgaccaaagaacctacacgtggtcgactcgacacgtagtacggaaccggcccgtaggaacgacggacgaacccgacgtaaccggtccgttggtcgttaacgttccgttggtcgacggacgacccgacccccgttagttcgggaacgggtactaacgaggtcggggactccgttaacgttaaccgg

SEQ ID NO: 398259 - DNA, 666 bp, Homo sapiens
  misc_feature: GZ8MTXP01B8U0Z.38.4.A04.1.454.CMB.2.raw
  modified_base (285)..(285): a, c, t, g, unknown or other
  modified_base (307)..(307): a, c, t, g, unknown or other
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaaatactatgtggatcctgtgaagggccgattcgccatctccagagacacgcaagaactcactgnggctgcacatgacggcctgagnggcgacgacacggctgtgtacttctgtgcgagccgcccccatggagggcctacaggtgggacncgtacgtctttgactacggtgggggcccgacgggtaaccctggtccgaccgtcgtccctcaaccggtcctacccgacccgaacgggcccctaacgtcccgggttccctttccccccggtcgggtcccctacccccttccccgtacccgaacggaaccgcccgtaacccgtcggtcggggggccaacgaccggtcccgggcccgttcggggcccgttcggtccctcgggttaccgaacggttaccctttaaccgttccccgtaacggttcgaacgttccgtaacgttcggaacgggg

SEQ ID NO: 398260 - DNA, 643 bp, Homo sapiens
  misc_feature: GZ8MTXP01CLUXC.38.4.A04.1.454.CMB.2.raw
  modified_base (282)..(282): a, c, t, g, unknown or other
  modified_base (331)..(331): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaagggccattcgccatctcagaggacacgccaagactcactgnggctgcacatgaacggcctgagaggcgacgacacggctgtgtactttcnggtgcgagacgcccccagtggacgggtctacgaggtagggacgtctacgtacttttgggacctacggtcgggggaccacggggtaacccttgggtacctaccgtctcccgtcacgtccctaccaccgaaccgggccctacgtccgggtccctttcccccggtcggtccctacccctcccgtacccgaacgaccgccgtacccgtcggtacgggggcaccggacggcccggtcccgttcgggccttcggtccgtcggttacgacggttaccttaaccgtccgtaacgtgtacgttcgtaacgttgggaacggg

SEQ ID NO: 398261 - DNA, 807 bp, Homo sapiens
  misc_feature: GZ8MTXP01CPUJC.38.4.A04.1.454.CMB.2.raw
  modified_base (290)..(290): a, c, t, g, unknown or other
  modified_base (293)..(293): a, c, t, g, unknown or other
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcttgggtccgagggccgggggggtccctggacgactctcctgtgcagcctctgcattcacctttagaactattaangancgtggtcccncagcctccgaggggacgggctagggagtggggtcgacccaggctaattaacccgaaagtagtacgggaaaccccgttaaggtaaaaaaacttccgttaaagtggttaacgggaacttccggtagggtacggggtaaaaccggggtccccgtaagtttacccgggaccctaagttaccctaccgaaacgaacgggaaaccaaacccggaacccgaaaacggtaaaccttaccgaaccgttagggttacggacccgttagggaacccaacggtaaacgttaaccggggaaacccgggtacccgtaagggaacggaaccgggtacccggaaaccggaaccgtaaccgggtacccgttgggttacggttaaccgtttcccggttgggttaccggaccggtaaaccggtccccgaaccccccccggttaggttacggggaaccggggtaccgtaacccggtaaggggttccggggaacgttaacccggttaaccggttttaaacccggg

SEQ ID NO: 398262 - DNA, 622 bp, Homo sapiens
  misc_feature: GZ8MTXP01DV5TF.38.4.A04.1.454.CMB.2.raw
tcagtcgatcacgtcacgaccggtgctcgatttagagtagtgatcaggggggagtcagtcccagtcaggacacagcatggacatgagggtccccgctcagctcctggggctcctgctgctctggctcccaggtgccggatgtgacatccagttcggcccagtctccatccttctgtctgcatctgtaggggacagagtcaccatcacttgccggcagtcagggctagttagacttcgtttagcctggtatcaagacaaaaaccgagggaaaccgcccctaacctcctgatactatggtgactatcctattttgacgtaaaggttcggggtacctagtcgtaaaggttcaggtccggccgtaggtaggattccggtagggaaacagtaacttcgaacgtctacacaactcagcagcctgacagtccgtaggagtactacgagtactaattattagttacgtacttaacgtacgttaaccttaaacttacccgttaaccccctagttaaccggttttcggaccggtaacggggtaacctaaagggttaagaagttaacgtaaacaaacgtactggttacggcttacgaacctactaacgttcgtattccttcttaacgttcccc

SEQ ID NO: 398263 - DNA, 527 bp, Homo sapiens
  misc_feature: GZ8MTXP01AZIMM.38.4.A04.1.454.CMB.2.raw
  modified_base (252)..(252): a, c, t, g, unknown or other
  modified_base (291)..(291): a, c, t, g, unknown or other
  modified_base (339)..(339): a, c, t, g, unknown or other
  modified_base (444)..(444): a, c, t, g, unknown or other
  modified_base (497)..(497): a, c, t, g, unknown or other
  modified_base (510)..(510): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtgctatttagaaggtgtcagtgtgaggtgcaactggtggagtctgggggaggcttggtccaggccggggggtcctgagactctcctgtgcagcctcngctattcacctttagaacttatttaatgagctgggtccncagcctcgagggagggctggagtgggtggccaggcaagttaaccaagntggactagaaaaaatctatgtaggactcgtgtaggaagggccgaattccgctatctccagacgacaacgccaaagaactcactgtggctgcacatgaacggccgngagaggcgacgacgacgcgtcgtgtctcttgtgcgacgacgccccgccgcggnggcgtaacgaggnggacgtcgttaacgtcg

SEQ ID NO: 398264 - DNA, 590 bp, Homo sapiens
  misc_feature: GZ8MTXP01A0YN7.38.4.A04.1.454.CMB.2.raw
  modified_base (287)..(287): a, c, t, g, unknown or other
  modified_base (311)..(311): a, c, t, g, unknown or other
  modified_base (367)..(367): a, c, t, g, unknown or other
  modified_base (375)..(375): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtgaaaaaatctatgtggactctgtgaagggccgattcgccatctccagagacaacgccaaagaactcactgnggctgcacatgaacggcctggagnggcgacgacacggctgtgtacttcgtgtgcgagacgcccccaatggagggctacgnggtggganctacgactttgactacgtggggaccagggaccctggtccacgtctcctcacgcctccaccgaacgggcccagtccggtccttccccgtcggccaccctcctaccaaagcgaccaccgtcgtcgggggaccacgcggccggccgttggggccttcggccgtggaccgaacgggccttaaccttcccgaacgttcgattcccgaacgttggaacggg

SEQ ID NO: 398265 - DNA, 560 bp, Homo sapiens
  misc_feature: GZ8MTXP01C29SH.38.4.A04.1.454.CMB.2.raw
  modified_base (257)..(257): a, c, t, g, unknown or other
  modified_base (283)..(283): a, c, t, g, unknown or other
  modified_base (295)..(295): a, c, t, g, unknown or other
  modified_base (448)..(448): a, c, t, g, unknown or other
  modified_base (520)..(520): a, c, t, g, unknown or other
  modified_base (541)..(541): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcacatggaattggggctgagcgtggtttctgtgctatttagaggtgtcagtgtgaggtgcaacgtggtggagtcgtggggggagtcttggtccgagggccgggggggtccctgagactctcctgtgcagcctcngctattcactttagtaactatttaangagcgtggtccncagcctccgagggaaggggctggaggtgggtgccagctaattaaccgaagataggaacctagaaaaatctaagtgtaaggactgtgtagggaaacggggtccctagttccgacatcctaccgagacgaacaacgaccaaagaactcatgcgcngacagactggaaacgccgagagacggcgacgcgacggtctgtgttaactcgttggtcgcgacgccgccccgngttcggaacggctaacgaggngggactcgttaacgtaacg

SEQ ID NO: 398266 - DNA, 588 bp, Homo sapiens
  misc_feature: GZ8MTXP01CI9S3.38.4.A04.1.454.CMB.2.raw
  modified_base (263)..(263): a, c, t, g, unknown or other
  modified_base (300)..(300): a, c, t, g, unknown or other
  modified_base (327)..(327): a, c, t, g, unknown or other
  modified_base (329)..(329): a, c, t, g, unknown or other
  modified_base (339)..(339): a, c, t, g, unknown or other
  modified_base (369)..(369): a, c, t, g, unknown or other
  modified_base (536)..(536): a, c, t, g, unknown or other
  modified_base (558)..(558): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggtttttccttgttgcttattttagaaggtgtccagtgtgaggtgcaacgtggtggagtcgtgggggagcgttggtccgaggccggggggtcctgagactctcctgtgcagcctngcattcacctttagaactatttaatgagcgtggtccncagcctcgagggagggctggagtggtncngacatacagntaggacctagaaaaatctagtgtaggactntggtaggaaacgggtcctaattccggacctatacctaccaaggacgaaccgaacgacccgaaacgaacctacaccgtggtcgctcgaccacgacgtacggaaccggccgtaggagacggacgacgacgacgtctgtgtaactgttggtcgcggacgccgacccccgngttcgggaagggaccgttaagngggtacgggacgtccgttaacggtttaacg

SEQ ID NO: 398267 - DNA, 750 bp, Homo sapiens
  misc_feature: GZ8MTXP01CELYU.38.4.A04.1.454.CMB.2.raw
  modified_base (282)..(282): a, c, t, g, unknown or other
  modified_base (323)..(323): a, c, t, g, unknown or other
  modified_base (361)..(361): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggaacgtagaaaaatctatgtggactctgtgaaggccattcgccatctcagagacaacgccaagactcactgnggctgcacatgaacggctgagaggcgacgacacggctggtntactttctggtgcgagcgcccccagtggaggctaacgnggtgggactcgtaaccgtagtttcgaacgtaccgggtcgggggaccctaacgggtaaaccccgttcgggtacccgtaacccggtccgtacccttaccgaacgtccccgttacccgaaacccggaaaccggggacccctaacggttcccggggtttaccccctttccccccggtcgggtacccctaacccccgttacccctacccgaaaccggaccgtacccgaaccccgttccgggttccggggggaccaaaccggccgggccccggggtcccggttcgggggtcccgttaccggtacccggttcgggttaacccggaaacgggttacccttaacccgtttacccgaaccgggtttagaccgttaccggaaccgttgggtaaccggggg

SEQ ID NO: 398268 - DNA, 623 bp, Homo sapiens
  misc_feature: GZ8MTXP01EF5VE.38.4.A04.1.454.CMB.2.raw
  modified_base (269)..(269): a, c, t, g, unknown or other
  modified_base (289)..(289): a, c, t, g, unknown or other
  modified_base (374)..(374): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaaggggctggaggtgggtggccagcaattaaaccaagatggaacgtagaaaaaatctatgtggactctgtgaagggccattcgcatctccaganacaacgcaagaactcactgnggctgcacatgaacggctgagaggcgacgacacggctgtgtacttctgtgcgagacgcccccagtggagggctacgaggtgggancgtacgtactttgactacggtcgggggaccacgggaaccctggtccaccgtctcctcgacgccctaccaccgaacgggccctagtccggttcccttcccccggtcggccctacccctcctaccaacgaccgccaccgtcggtcgggggccaccgcggcccggtcccgttggggccttcggcccgttgggttaccgaacgggttaccttaaccgttccgaacggttgacgttcgtaacgttcggaacggg

SEQ ID NO: 398269 - DNA, 630 bp, Homo sapiens
  misc_feature: GZ8MTXP01DME7M.38.4.A04.1.454.CMB.2.raw
  modified_base (238)..(238): a, c, t, g, unknown or other
  modified_base (284)..(284): a, c, t, g, unknown or other
  modified_base (291)..(291): a, c, t, g, unknown or other
  modified_base (304)..(304): a, c, t, g, unknown or other
  modified_base (331)..(331): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaagggctggagtgggtggccagcaattaaccaagatggacgtagaaaaaatctatgtggactntgtgaaggccattcgcatctccagagacaacgcaagaactcactgngctgcanatgaacgctgagngcgacgacacggctggtgtactttcgnggtgcgaaggaccgccccccaagtggagggctaacgnggtaggggatccgtaacgtacttttagaacctcgggtgggggacccaacgggaacccgtcggtccacccggtctcctcacgccctaccaccgacggcccacgtccgtcccttccccggtcgccctaccctccctaccaacgacgacctacccgtcggtcgggggccacgcggcccggccgttgggcttacgtccgtcggttaccgaacgggttaccttaaccgttaccgcggttcgacgttaccgaacgttcggaaccgggg

SEQ ID NO: 398270 - DNA, 624 bp, Homo sapiens
  misc_feature: GZ8MTXP01CJHMD.38.4.A04.1.454.CMB.2.raw
  modified_base (284)..(284): a, c, t, g, unknown or other
  modified_base (333)..(333): a, c, t, g, unknown or other
  modified_base (363)..(363): a, c, t, g, unknown or other
  modified_base (371)..(371): a, c, t, g, unknown or other
  modified_base (392)..(392): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaaatctatgtggactctgtgaagggccattcgccatctcagagacaacgccaagactcactgnggctgcacatgaacggctgaggaggcgacgacacggctgtgtactttcngtgcgagacgcccccagtggagggctacgnggtgggancgtacgtactttgactacggngggggccaacgggtaccctggtccaccgtctcctcacgccctccaccgacgggccctacgtccggtccccttcccccggcggtccctaccccctccctccgaacgcgccgacccgttcgtcgggggccaccgcggcccggcccgttcgggccttcggtaccctggggttacccgacgggttacccttaaccttcccgaacggttcgacgttccgtaacgttcggaaccgggg

SEQ ID NO: 398271 - DNA, 598 bp, Homo sapiens
  misc_feature: GZ8MTXP01EA0TL.38.4.A04.1.454.CMB.2.raw
  modified_base (256)..(256): a, c, t, g, unknown or other
  modified_base (263)..(263): a, c, t, g, unknown or other
  modified_base (285)..(285): a, c, t, g, unknown or other
  modified_base (372)..(372): a, c, t, g, unknown or other
tcagtcgatcacgtcacgaccggtgctcgatttagagtagtgatcagggggagtcagtcccagtcaggacacagcatggacatgagggtccccgctcagctcccggggctcctgctgctctggctcccaggtgccggatgtgacatccagttggcccagtctccatccttcctgtctgcatctgtagggacagagtcaccatcacttgccggcagtcagggcattaggactcgttagcctggtatcagacaaaacnggaaacncccctaactctgatctatggtncatcctattttcgacaaaggtcgggtacccagtcgaaaggttcaggcggctacggtggatcgtagggacaagtaattcagtctacanaatcagcagcctagcagctaggatatactgactaatttattattgtactaactagttaaccttaataccgttacccccagttaccgtttacggacccgtaaaggggtaccctaaggttcgggaaactaacgttaaacgtaaaacccgttacgttaggacggttaccttggaccctaacctagttcctcggttaccctttacgtaacccgttccccgtttaaccccg

SEQ ID NO: 398272 - DNA, 584 bp, Homo sapiens
  misc_feature: GZ8MTXP01B9G8Z.38.4.A04.1.454.CMB.2.raw
  modified_base (283)..(283): a, c, t, g, unknown or other
  modified_base (372)..(372): a, c, t, g, unknown or other
  modified_base (505)..(505): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctcagagacaacgccaagaactcactgnggctgcacatgaacggcctgagaggcgacgacacggctgtgtactttctggtgcgagacgccccccagtggaggctacgagtagggganctacgtactttgactacgtgggggccacgggaccctggtcaccgtctcctcacgccctccaccacgggcccacgtcgtccttcccccggtcgcctcccctccctaccaacgacgccacccgtcgtcgggggcncgacggccggcccgcgggcttcgcccgtggttccgacggcctaacgttccaacgtcgagttcgtaacgttcggaacggg

SEQ ID NO: 398273 - DNA, 554 bp, Homo sapiens
  misc_feature: GZ8MTXP01AXEOH.38.4.A04.1.454.CMB.2.raw
  modified_base (288)..(288): a, c, t, g, unknown or other
  modified_base (509)..(509): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccaggccgggggggtccctgagactctcctgtgcagcctctgcattcacctttagaactatttaangagctgggtccgccagcctccgaggggaaggggctgggaggtggggtggccagcattaaccaagatggaccgtagaaaatctatgtagactcgtgtaggaagggccgattcgacccatctcccagacgacaacgccaaagactcactgagctgcacgatcggaacggcctggagaggcgacgcgtacggctgtgtaacttcgttgtcgcgagcgcccccgnttcgggaacggggctaacgaggtgggacgtcgttaacgttaaccg

SEQ ID NO: 398274 - DNA, 561 bp, Homo sapiens
  misc_feature: GZ8MTXP01ECPQL.38.4.A04.1.454.CMB.2.raw
  modified_base (301)..(301): a, c, t, g, unknown or other
  modified_base (502)..(502): a, c, t, g, unknown or other
  modified_base (521)..(521): a, c, t, g, unknown or other
  modified_base (539)..(539): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcttggtccgaggcccgggggggtcctgagactctcctgtgcagcctctgcattcaacctttagaactatttaatgagctggtccncagcctcgagggaggggctggagtgggtgccagactattaaccaagatggaacctagaaaaatctatgaggactcgtagtaggaacgggcctattcgcctatcctacagacgaacaaccgaccaaagaactcactgtacgctgcacgatacggaaccggccgtaggaacgacggcgaacgacgacggcttagtgtaacttnggtcgcgacgaccgccccngttcggaacggctaacgnggtcggactcgttaacgtaacg

SEQ ID NO: 398275 - DNA, 591 bp, Homo sapiens
  misc_feature: GZ8MTXP01CFSFO.38.4.A04.1.454.CMB.2.raw
  modified_base (269)..(269): a, c, t, g, unknown or other
  modified_base (542)..(542): a, c, t, g, unknown or other
  modified_base (563)..(563): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtggggggagcgttgggtccgagggcccgggggggtccctggagtctctcctgtgcagccctntgctattctacctttagtaacttatttaatgagcgtcgggtcccgcacgccctccgaggggacggggctgggagtgggtgccaggctaagttaaccaagagtaggaaccgtagaaaaatctagtgtacgactcgtgtaggaacgggcattccgcactctccgagacgaacaacgaccaaagactcacgtgcgctgacacgagtacggaccgccgtagagacggcgaccgacgcggtctgtacgtcttcgttggtcgacggacgcccgccccgngttcgggaacgggctaacggngggtcgggacgtaaccgttgttaaccgg

SEQ ID NO: 398276 - DNA, 621 bp, Homo sapiens
  misc_feature: GZ8MTXP01EQWZB.38.4.A04.1.454.CMB.2.raw
  modified_base (313)..(313): a, c, t, g, unknown or other
  modified_base (394)..(394): a, c, t, g, unknown or other
  modified_base (426)..(426): a, c, t, g, unknown or other
tcagtcgatcacgtcacgaccggtgctcgatttagagtagtgatcaggggggagtcagtcccagtcaggacacagcatggacatgagggtccccgctcagctccgtggggctcctgctgctctggctcccaggtgccggatgtgacatccagttcggcccagtctccatccttctgtctgcatcgtggtaggggacagagtcaccatcacgttcggccggcaggtcgagggctagttaggacttcgtttagcctaggtatacaagaaccaaaaaccgagggaaacctccccctaactcctagatctagtggtnctatctatttgagtaaggtcgggtaccatcgtagtcgaggcgacaggtgatcgtagggaaactagtaacttcacgtcctanaactatcgagcagctgcagcgtaggatatacngtacttaacttattagttacgtacttaacgtacttacttaaacttaacccgttaccctaacgtttacggtttccggaccggtaacggggtaacctaaggttaacgggaattaacgtaaaccgttaaacggtacgttggttacgttcgttacgaacctactaacttcgttaccttactttccgttaaccttccccg

SEQ ID NO: 398277 - DNA, 576 bp, Homo sapiens
  misc_feature: GZ8MTXP01AL8V7.38.4.A04.1.454.CMB.2.raw
  modified_base (506)..(506): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcttgggtccagggcccggggggtccctgagactctcctgtgcagcctctgctattctacctttagtaactatttaatgagctgggtccgcacgcctccgagggaaggggctggagtgggtgcagcataaccaagatgacgtagaaaatactatgtagactcgtgtgggaaacgggccgattcgcctatcctacagagaacaaccgacaaacgaactcacgtgtggctgacaacgagtacggaaccggaccgtagaggacggacgaaccgacgaccggactgtggtaaccttnttggtgcgacgaccgcccccgcgttacggaaggcgtaacgtaggtggggacgtaacgttaacgttaaccg

SEQ ID NO: 398278 - DNA, 767 bp, Homo sapiens
  misc_feature: GZ8MTXP01AGO2Y.38.4.A04.1.454.CMB.2.raw
  modified_base (295)..(295): a, c, t, g, unknown or other
  modified_base (306)..(306): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggaggtcttgggtccgagggcccggggggtccctggacgtactctccgtgtgcagcctctgcattcactttagaactattangagctggtccncagcctccgaggagggctggagtgggtgccagctaattaaccgaagagtaggacccgtaagaaaaattctatggtagacctcgtgtacgggaaacggggtcccgtaagtttcccgacctacttccctaccgaacggaacgaaaccgaaaccggaacccgtaaaacgtaaaccgttaccaaacgttacgggtcgggtaccgttacggacccaaacggtaacgttaaccggggaaaccgggtaccccggttaagggaacggggaacggggacccgggaaacccggaacggtaacccggggtccgttacggtttaccggtttaaacgtttcccggttagggttacgggacccgggaaaccggaacccccgggttaccccccgaaccggttacggggaaacgggggtacccttaaaccggtaggggtacgggttaccggtaacccgttaaccgggtttaacccgg

SEQ ID NO: 398279 - DNA, 634 bp, Homo sapiens
  misc_feature: GZ8MTXP01AKODG.38.4.A04.1.454.CMB.2.raw
  modified_base (237)..(237): a, c, t, g, unknown or other
  modified_base (257)..(257): a, c, t, g, unknown or other
  modified_base (262)..(262): a, c, t, g, unknown or other
  modified_base (280)..(280): a, c, t, g, unknown or other
tcagtcgatcacgtcacgaccggtgctcgatttagagtagtgatcagggggaagaccgatgggcccgttgggggaggcttggtccaggccgggggggtccctgagactctcctgtgcagcctctgcattcacctttagtaactatttaatgagctgggtccgccagcctccgagggaagggctggagtgggtgccagcaattaaccaagatggaacgtagaaaaatctatgtgactntgtgaaggcattcgccatcncaganacaacgcaagactcatgngctgcacatgaacgctgagaggcgacgacacggctgtgtacttcgtgtgcgagtaccgcccccaagtggagggctacgaggtagggactctacgtactttgaccgtacggtcggggaccacgggaaccctggtaccaccgtctcctcacgccctaccaaccgacgggcccctagtccggttccccttcccccggtcggacccctacccctccctaaccgaacgccgacccgtacccgttcgggtcggggacccacggacggcccgggtcccgttcgggccttcggcccgttgggttaccgaaagggttacccttaacgttcccgaaggttcgacgttcgaacgttggaaccggg

SEQ ID NO: 398280 - DNA, 661 bp, Homo sapiens
  misc_feature: GZ8MTXP01D3IV5.38.4.A04.1.454.CMB.2.raw
  modified_base (236)..(236): a, c, t, g, unknown or other
  modified_base (280)..(280): a, c, t, g, unknown or other
  modified_base (303)..(303): a, c, t, g, unknown or other
  modified_base (331)..(331): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaaatctatgtggactntgtgaaggcattcgccatctcagagacaacgcaagactcactgngctgcacagtgaacggctgaagnggcgacgacgacggctgtgtactttcgngtgcgagaccgcccccagtcggagggctacgaggtaggggatccgtacgtacgtttcggaccgttacggtcgggggaccgtaacggggaaccccgttggtaccctaccggttcctccttaccgaacgtcccctaccgaacccggaaaccgggcccctaacgttcccggttccccttcccccgggttcggaccctaccccgtaccctaccgaacgaccgcctacccggttccggtacgggggccaacgtcgggccggtcccgttggggtccttcggccgtcggacgacgggttaccttaacgtcgcgacggttcgacgtccgaacgtcggg

SEQ ID NO: 398281 - DNA, 831 bp, Homo sapiens
  misc_feature: GZ8MTXP01C7LAV.38.4.A04.1.454.CMB.2.raw
  modified_base (282)..(282): a, c, t, g, unknown or other
  modified_base (347)..(347): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgcagcctccgagggaagggctggagtgggtggccagcattaaccaagatggacgtgaaaaatctatgtggactctgtgaagggccgattcgccatctccagagacaacgccaagactcactgnggctgcaacagtacgaaccggctaggagagggacgacgacgacggtctggtcgtttacctttcgnggtcgacggaacggccacccccccgaagtcgggacggggtaccttaacggaagggttggggaactccgttaacggtaccgtttagggaaccgttacgggtcgggggacccgaaacgggggtaaaccccttcgggtacccgtaacccggttcctaccccgttacccgaacgtcccccgttaacccgaaaccccggtaaacggggaccccctaacggtttacccccgggttcccccgtttaccccccggttccggggacccccttaaaccccccttcccgttaaccccgaaacgggacccgacccgtaacccgtttccgggtaccggggggtcccaaacccggaaccggggccccggggtccccccggtttgggggccccgttacgggtccccgttacgggttaacccgttaaacgggttaacccttaacccgtttaccccgtaacgggtcgtaaccgtttacccggaacgttcgggaacccgggg

SEQ ID NO: 398282 - DNA, 683 bp, Homo sapiens
  misc_feature: GZ8MTXP01CH8KV.38.4.A04.1.454.CMB.2.raw
  modified_base (300)..(300): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttcggcccagtctccatccttcctgtctgcatcgtggtaggggacagagtcaccatcacgttgccggcagtcgagggctagttaggacttcgtttagccgtggtatacagaacaaaaaccgaggaaacctcccctaactctagatctagnggtcgctatcctagtttgacgtaaaggtcgggtacccagtacgtaaggttcgacggtcgaccgtaggtgagtcgagggaaactagtaagttcacgttcacaacaatcgacgacacgtcctgacgacgtcccgtagggtacgtaacttacgtacgtaacttaaacttttagtttacgtttacgtaacttaacgtaaccgtttaaacctttaaaccgtttaaccccgttaacccccttaggtttaaccggttttccgggaaccggtaacgggggttaaacctaagggttaaggaacgttaaccgtaaacgttaaacgtaacggttcggacggttcacggtaacctacttaagttccttacgttccttaaccgttaacgttccccg

SEQ ID NO: 398283 - DNA, 701 bp, Homo sapiens
  misc_feature: GZ8MTXP01CR16W.38.4.A04.1.454.CMB.2.raw
  modified_base (316)..(316): a, c, t, g, unknown or other
  modified_base (383)..(383): a, c, t, g, unknown or other
tcagtcgatcacgtcacgaccggtgctcgatttagagtagtgatcaggggggtctcagagaggagccttagccctggactccaaggcctttccacttggtgatcagcactgagcacagaggactcaccatggaattggggctgagcttgggttttccttgttgcttattttagaggtgtccagtgtgaggtgcaacgtggtggagtcgtgggggaggcgttgggtccgagggcccggggggggtccctggacgtactctcctgtcgcagcctctgctattcacctttagaacttattaatgagtcgtcgggtcccncacgccctacggagggggaaggggcgtagggaggtgggggtcgaccaggactaattaaaccaaaggngtaggaaccgtaagaaaaaatcgtaagtggtacggtacttcgtagggtacggaacggggtccgtagttccgcctactccgtacgaagaacgaaccaaaccgaccaaacgaacctctacgtggtacgctagaccaacgtagtacgggaaaccgtccgtaggacggacgggacggaaccggaccggaccggtcgtacggttcgttaaccgtttcggttggtccggccggaacggaccccgaccccccgttcggttacggggtaacgggaccgttaaccgggtagggtacggggaccgttaacgttaacccgggtttaacg

SEQ ID NO: 398284 - DNA, 827 bp, Homo sapiens
  misc_feature: GZ8MTXP01CHTI8.38.4.A04.1.454.CMB.2.raw
  modified_base (391)..(391): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaaatctatgtggactctgtgaagggccattcgcatctcagagacaacgcaagactcactgtggctgcacatggaaccggcctggaggacgggcgaacggaccacgggctgtacggttactttcgtggttcggcgaaggaccgccccccctagtgggacggggtcctaacgngggtaggggacgtcgttaccgtaacgttttggaacccgttacgggtcggggggacccgaacggggtaaccccgttgggtacccgtacccggttcccttacccgtccgtaccgtcccccttacccgaacccggaacccggggccccctaacggttcccgggttcccccgtttcccccccgggtcggggtccccctaaccccccgttcccccgtaaccccgaaacggtacccgtaccccgtaaccccggtcgggttaccggggggggacccaacccggaacccgggccccggggtcccccgggttcgggggtccccgttaccgggtccccgttcgggggttaacccggaacgggttaaaccccgtttaaccccgtttacccccgtaacgggttccggtaccgttacccgggtaaccggttaacggggtaacccggggg

SEQ ID NO: 398285 - DNA, 695 bp, Homo sapiens
  misc_feature: GZ8MTXP01CW1G6.38.4.A04.1.454.CMB.2.raw
  modified_base (268)..(268): a, c, t, g, unknown or other
  modified_base (282)..(282): a, c, t, g, unknown or other
  modified_base (325)..(325): a, c, t, g, unknown or other
  modified_base (334)..(334): a, c, t, g, unknown or other
  modified_base (375)..(375): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtgaaaaatctatgtggactctgtgaaggccgattcgccatctccagagacaacncaaagactcactgnggctgcaacagtgaacggctggagaggcgacgacacggctgtntactttcgngtgcgagccgcccccatggaggcctaacgaggtacgggacnctaacggtactttagaccgttaacgggtcggggacccaacggggaacccttcgggtaccacccggttcctcctaccacgtcccctaccccgaaccgaaccgggcccctaagttcccggtcccctttacccccggtcgggacccctaaccccctcctacccgaaacgccgacctaaccccgtcggtcgggggaccaaccgaccgggtcccgggtccccggcgggtcccgttccggcccgtttacgggacccgttaacgggttaccctttaaccctacccgtaaccggtagtaaccttccgggtaaccgttgggaaccgggg

SEQ ID NO: 398286 - DNA, 741 bp, Homo sapiens
  misc_feature: GZ8MTXP01EG8RF.38.4.A04.1.454.CMB.2.raw
  modified_base (288)..(288): a, c, t, g, unknown or other
  modified_base (715)..(715): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcgttggtccgaggccggggggtccctgagactctcctgtgcagcctctgctattcacttagtaactattangagcgtggtcccgcacgcccgtccggaagggggaacggggcgtgggaggtgggggtcggacccgaggacctaaacgtttaaaacccgaaaggtaagtacggggtaaaccggtaaaggtaaaaaaacttaccgttaagttaacgggttacgggtaacctttccgtaggggttacgggaaacgggggtccccgtaacgtttcccggaccctattccccgtacccgaaggaacgaaacccgaaaaccggtaacccaaaaggaaacccttaccgaacggttacgggtcgggtacctacgggacctaacgtaacggttaacgggaaacccgggcccgtagggaacggacgggaccggaacgacgaccggtctggtaacgttcgttcgtggttcgacgacgacccgcccccttaggtcggacggtaactacgngggttaggtcgttaacgttaacccgg

SEQ ID NO: 398287 - DNA, 521 bp, Homo sapiens
  misc_feature: GZ8MTXP01EID77.38.4.A04.1.454.CMB.2.raw
  modified_base (294)..(294): a, c, t, g, unknown or other
  modified_base (383)..(383): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaatggtggagtcgtgggggagcttggtccaggccggggggtccctgagctctctgtgcagcctctgcattcacctttagtaactattaatgagcgtggtccnccagcctcgagggaagggctggagtggtgccagcataacaagatggactagaaaatctatgtagactgtgtagaaggcattcgctatcncagagacacgacaaagactcactgtgctgcacgatgaacggctaggacgaggcgacgaacgcgggctggtgtaacttcgttgtgcgacgacgcccccgagttcggaagggctaacgaggtgggactcgttcgttaacg

SEQ ID NO: 398288 - DNA, 546 bp, Homo sapiens
  misc_feature: GZ8MTXP01AK67O.38.4.A04.1.454.CMB.2.raw
  modified_base (295)..(295): a, c, t, g, unknown or other
  modified_base (317)..(317): a, c, t, g, unknown or other
  modified_base (337)..(337): a, c, t, g, unknown or other
  modified_base (358)..(358): a, c, t, g, unknown or other
  modified_base (388)..(388): a, c, t, g, unknown or other
  modified_base (413)..(413): a, c, t, g, unknown or other
  modified_base (423)..(423): a, c, t, g, unknown or other
  modified_base (501)..(501): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtagctatttagagtgtcagtgtgaggtgcaacgtggtggagtcgtgggggaggcgttggtccgaggccgggggggtcctggagactctcctgtagcagcctctgctattcacctttagaactattaatgagctgggtccncagcctcgagggagggctaggngtgggtcgcagcataacagntaggacctagaaaatctaagngtagactgtgtggaagggcattcgcaatcncgaagacgacaacgaccaagaaccncgtacgtggngcagacacggagacggaccgcgtagacggaggacgacgacgtacgtcgtgtcgtcgttgcgtcgcgacgcccgcccgngttacggaacggtacaacggacggtcggacgtaacgttaacgtcg

SEQ ID NO: 398289 - DNA, 611 bp, Homo sapiens
  misc_feature: GZ8MTXP01AG9NV.38.4.A04.1.454.CMB.2.raw
  modified_base (311)..(311): a, c, t, g, unknown or other
  modified_base (582)..(582): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcttggtccgagggccggggggtccctggagacctctcctgtcgcagccctctgcctattctacctttagtaacttattaatgagcgtgggtcccncgacgccctaccggaggggagggctggagtgggtgccaagactaacttaaaccaagtacgtaggaaccgtaagaaaaatctaagtgtaacggacctgtagtggaacgggctattcgactatccacgagacacaaccgacaacgaactcacgtaggtgcagacacgacgtagaccgcgaggacggacggcgaaccgacgacgtcgttacgtcgttaactcgttaggcggccgaacgcccgacccccgaggttacggaacgggtacgtaacgnggtacgggacgtccgttaacggttaaccg

SEQ ID NO: 398290 - DNA, 712 bp, Homo sapiens
  misc_feature: GZ8MTXP01AG14P.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcttgggtccgagggccggggggtccctggagactctctgtgcagcctctgctattcacctttagaacttattaatgagtcgtcgggtccgccacgcctccgaggggaagggggtctgggaggtggggtcggaccagctaattaaaccaaaggtagtaggaaccgtaagaaaaattctaagtggtaaggaacttcgtggtacgggaaacggggccccgtaagtttccggacctaacgttccgtacccgaaggaacgaaccgaaaccgacccaaaacggtaacctacgaaccgtggttcggcgttcgaccgaacgtaagtacggtaaaccggacccgtaggaacggacgggccggaaaccggaccgaccgggtcgttacggttcggttaacgttcgttagggtacggaccggtacggaccccggacccccgttacggttacgggaacggggtaccctaacggtaaggggtcggggacgtccgttaaccggtttaaccgg

SEQ ID NO: 398291 - DNA, 624 bp, Homo sapiens
  misc_feature: GZ8MTXP01BVB9U.38.4.A04.1.454.CMB.2.raw
  modified_base (256)..(256): a, c, t, g, unknown or other
  modified_base (283)..(283): a, c, t, g, unknown or other
  modified_base (291)..(291): a, c, t, g, unknown or other
  modified_base (305)..(305): a, c, t, g, unknown or other
  modified_base (513)..(513): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcaccttttagtaactatttaatgagctgggtccgccagcctccagggaaggggctggagtgggtggccagcattaaccaagatggacgtgaaaaatctatgtggactctgtgaagggccgattcgcatcnccagagacaacgccaagaactcactgnggctgcanatgaacggctgagnggcgacgacacggctgtcgtactttctgtgcgagacgcccccagtggagggctacgaggtgggatctagactttgactacggtcgggggccaagggaccctggtccaccgtcctcctcacgccctaccgaccgaacgggcccagtccgtccttcccccggtcgcctacccctccgtacccaacgacgccgaccctcggtcgggggacncgacggcccgggcccgttcggggccttcggtcccgtcgggttaccgaaacgggttacccttaacgtttccccgaacggttcggtacgttccggtaacgttcgggaacgggg

SEQ ID NO: 398292 - DNA, 586 bp, Homo sapiens
  misc_feature: GZ8MTXP01DPXXR.38.4.A04.1.454.CMB.2.raw
  modified_base (443)..(443): a, c, t, g, unknown or other
  modified_base (498)..(498): a, c, t, g, unknown or other
  modified_base (555)..(555): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtggggggaggcgttgggtccgagggcccgggggggtccctggagactctcctgtgcagcctctgcattcacctttagtaactatttaatgagcgtcgggtccgccagccctccgaggggaggggctggaggtggtggccagcattaaaccaagatggaacctagaaaaatctaatgtaggactcgtgtggaagggccattcgctatctccagacgacaacaccaaagaactcactgngctgcacgagtacggaaccggccgtgaggacggcggaaccgacgtacggctggtnttaacgttcgttagtgacgtacggccgacccccgagttcggaacgggtcctaacggngggtagggacgtaaccgttaacgttaaccgg

SEQ ID NO: 398293 - DNA, 767 bp, Homo sapiens
  misc_feature: GZ8MTXP01DMY0K.38.4.A04.1.454.CMB.2.raw
  modified_base (324)..(324): a, c, t, g, unknown or other
  modified_base (340)..(340): a, c, t, g, unknown or other
tcagtcgatcacgtcacgaccggtgctcgatttagagtagtgatcagggggaggtctcagagaggagccttatccctggactccaaggcctttccacttggtgatcagcactgagcacagaggactcaccatggaattggggctgagcttgggttttccttgttgcttattttagaaggtgtccagtgtgaggtgcaacgtggtggagtcggtggggggagtcgttcgggtccgacggggcccgggggggttccctggacgaccttccttccgtggtcgcacgtcctctgctacttacctaacctttaagtaaacttatttaangacgtcgtcgggtccncacgccgtacggagggggaacggggtcgtgggaggtggggtcggacccagactaaacttaaaccgaagacgtaaggacgtaaaagtaaaatactagtaaggtacgtaacgttcggtaggtacgggaacggggtcccgtacgtttccggaccctactcctaccgaaaggaaccgaaaccaaaccggaaccgtaaaacgtaacctaccgtaacgttcgggtaacgtcgtacggaccaaactaacggtaccgggtaaaccgggtaccgtacgggaacggacggggaaccgaaccggaaccggtaccgggtcgttaggttaacgttaccgtttcggtacgggttgaccggtacggaccccgttccccggttacggtaacgggacgggtaacgttaacggacggggttcggtaacgttcccgtttaaaccgg

SEQ ID NO: 398294 - DNA, 592 bp, Homo sapiens
  misc_feature: GZ8MTXP01EQ8NX.38.4.A04.1.454.CMB.2.raw
  modified_base (240)..(240): a, c, t, g, unknown or other
  modified_base (259)..(259): a, c, t, g, unknown or other
  modified_base (284)..(284): a, c, t, g, unknown or other
  modified_base (323)..(323): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaaggggctggagtgggtggccagcaattaaccaagatggaacgtagaaaaaatctatgtggactntgtgaaggcattcgcatcncagagacaacgcaaagactcactgngctgcacatgaacggctgagaggcgacgacacggctgtntacttcgtgtgcgagaccgcccccagtggacgggctacgaggtgggagtcgtacgtactttgaaccgtacggtcgggggaccaacgggaccctggtccaccgtctcctcacgccctaccaccgaacggcccacgtccggtcccttccccggtcggccctaccctccctaccaacgcgccaccgtcgtcggggcacgcggccggccgttgggcttcgccgtggttacgacggttacctaaccttccgaacgtgacgttcgtcgttgcggg

SEQ ID NO: 398295 - DNA, 704 bp, Homo sapiens
  misc_feature: GZ8MTXP01ABVLE.38.4.A04.1.454.CMB.2.raw
  modified_base (256)..(257): a, c, t, g, unknown or other
  modified_base (269)..(269): a, c, t, g, unknown or other
  modified_base (278)..(278): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtaggctatttagaaggtgccagtgtgaggtgcaactggtggagtctgggggaggcttgggtccaggccggggggtccctggagactctctgtgcagccctnnctatctacttanaactattangagcgtcggccgccagcccgtacggaggggagggtcgtagggaggtggggtcggacccgaggtacctaacgttaaccgaaggtacgtacggtaacccgtaaagtaaaacttacgtagtaggtaaccgacttcgtagggtacgggaacggggtcctacgttcgaccgtacgtaccgtaccgaacgaacgaacgaaccgaaccgaaacgtaacctaccgtacgtacgtacgtacgtacgtaccgacggtaacgtacggtaaccggaccgtacggaacggacggaccggaccggtaaccggtaccggtacggtcggttacgttaacgttcgttacggtacggaccggtacggacccgttaccccgaccggttacggaacgggtacggtaacggtacgggtacgggttacggtaaccgttaacgttaacg

SEQ ID NO: 398296 - DNA, 630 bp, Homo sapiens
  misc_feature: GZ8MTXP01AL8GA.38.4.A04.1.454.CMB.2.raw
  modified_base (280)..(280): a, c, t, g, unknown or other
  modified_base (328)..(328): a, c, t, g, unknown or other
  modified_base (364)..(364): a, c, t, g, unknown or other
tcagtcgatcacgtcacgaccggtgctcgatttagagtagtgatcagggggagaccgatgggcccttgggggaggcttggtccagccggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaagggccattcgccatctccagagacaacgcaagactcactgnggctgcacatgaacggcctgagaggcgacgacacggctgtgtacttcngtgcgagacgcccccatggagggctacgagtgggancgtacgtactttgactacgtgggggaccacgggaccctggtcaccgtctcctcacgcctacccaccgaacgggcccctactccggttcccttcccccggtcggaccctacccctaccctacccaaacgcgacccacccgttcggtcgggggccaccgacgggccggccccgttcggggtcccttcggacccgttggttaccgaaacgggttacccttaaccgttcccgtaacgttcgtaacgttccggtaacgttcggtaacgggg

SEQ ID NO: 398297 - DNA, 625 bp, Homo sapiens
  misc_feature: GZ8MTXP01BKCOF.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcttggtccagggcccggggggtccctgagactctcctgtgcagcctctgcattcacctttagaacttatttaatgagcgtgggtcccgccagcccgtccgaggggaggggctgggagtgggggtcgcccagcaattaaaccaagagtggaaccgtaagaaaaattctagtggtaggactcgtggtagaaacggggtcctagttccgcctatcctaccgaacggacgaaccaaaccgaccaaagaacctcacgtggtcgctgaccacgagtacggaaccggtccgtaggaaggacgggaccgaacggaccgacggggtcttaggtcgttaacctttcgttggtcggcgacgcccgcccccgttggttcggaacgggtcaacggtagggcgggacgtcgttaacgttaacgg

SEQ ID NO: 398298 - DNA, 687 bp, Homo sapiens
  misc_feature: GZ8MTXP01BCB6W.38.4.A04.1.454.CMB.2.raw
  modified_base (283)..(283): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaaccaagatggacgtagaaaaatctatgtggactctgtgaaggccattcgccatctccagagacaacgcaagactcactgnggctgcacagtgaacggcctggagaggcgacggcacggctgtgtactttgtgtgcgagaccgcccccagtggagggctacgaggtagggactcgtacgtactttggaccgtacgggtcgggggacccaacggggtacccgttcggtacctacccgttcctccgtacgacgccctacccgaccgaaccgggcccctacgttcccgggttccccttcccccgggtcggtaccctacccccgtaccctacccgaaacgccgaccctacccggttccggtcgggggaccaaccgccgggcccgggtccccggttgggggtccttcgggtacccgttacgggttaccgttaaccgggttacctttaacccgtccgtaacggtcgtacgttacgccgttgggaaccgggg

SEQ ID NO: 398299 - DNA, 703 bp, Homo sapiens
  misc_feature: GZ8MTXP01CGA8M.38.4.A04.1.454.CMB.2.raw
  modified_base (312)..(312): a, c, t, g, unknown or other
  modified_base (575)..(575): a, c, t, g, unknown or other
tcagtcgatcacgtcacgaccggtgctcgatttagagtagtgatcagggggtctcagagaggagccttagccctggactccaaggtctttccacttggtgatcagcactgagcacagaggactcaccatggaattggggctgagctgggttttccttgttgctattttagaaggtgtccagtgtgaggtgcaactggtggagtcgtgggggagctttgggtccgagggcccggggggggtccctgacgactctcctgtgcagcctctgcattcctaacctttagtaacttaattaatgagcgtagggtcccncagcccgtccggaggggaaggggctggggagtgggggtggcccagctaagttaaaccaagacgtaggaacccgttaagaaaattacgtagtggtaacgggtaacctgttagggtacgggaaacggggtccgaactttcggacctacgttccctacccgaaggaacgaaccaaacggacccaaacggtaacctacacgtgtcggccttgacacgagtacggaaaccggcctaggacggacgggacgaccggacgtaacccgggngttcggtcgttaaccgtttccgttggtcggaccgggaacgcccgggttacccccccgttaggttacgggaacccgggacgttaaccgaggggttagggaccgtaacgttaacccgggtttaacccggg

SEQ ID NO: 398300 - DNA, 662 bp, Homo sapiens
  misc_feature: GZ8MTXP01AJV9S.38.4.A04.1.454.CMB.2.raw
  modified_base (309)..(309): a, c, t, g, unknown or other
  modified_base (324)..(324): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagtcgttgggtttttccttgttgcttattttagaaggtgtccagtgtgaggtgcaacgtggtggagtcggtggggggagtcgttgggtccgacgggcccggggggtccctggacgtctctcctgtgcacgcctcgtgctattcctaacctttagtaacttatttaangagtcgtcggtcccncagccgtacggaggggagggcgtgggaggtgggtcgccagactaattaaaccgaagtagtaggaaccgtaaagaaaaattcgtaagtggtaacggtacttcgtgggtagggaacgggccgtagttccgactactctaccgagaacgaccgaaccgaccaaacgtaacctcacgtggtcgctacgaccaacgtacgtacgggaaccggccgtaggacggacggaccggaacggacgtcggtacttggtcgttaacgtcgttggacgacgaccggacccgacccccgttggttacggaacggtctaacggagggtacgggactaaccgttcgttaaccgg

SEQ ID NO: 398301 - DNA, 669 bp, Homo sapiens
  misc_feature: GZ8MTXP01C59QJ.38.4.A04.1.454.CMB.2.raw
  modified_base (281)..(281): a, c, t, g, unknown or other
  modified_base (304)..(304): a, c, t, g, unknown or other
  modified_base (330)..(330): a, c, t, g, unknown or other
  modified_base (341)..(341): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgcagcctccgagggaagggctggagtgggtgccagcattaaccaagatggacgtgaaaaaatctatgtggactctgtgaaggccgattcgccatctcagagacaacgcaagaactcactgnggctgcacatgaacggctgaagnggcgacgacacggctgtgtactttcnggtgcgacgcncccccagtggagggctaacgnggtgggactcgtaacgtactttaggaccgtacggtcgggggacccacggggtaaccctgggtccctacccgtcctcccgtccgacgtccctacccgaacccgaacgggcccctacgttcccggttccccttcccccggtcggacccctacccctccctaccgaacgccgcctacccgtcggtcgggggccaccgcgggtcccggcccggttggggtccttcggtcccgtcgggttaacccgttaacgggttaaccctttaaccgtacccgtaacggtcgtacgttcggtaaccgttgggaaccgggg

SEQ ID NO: 398302 - DNA, 598 bp, Homo sapiens
  misc_feature: GZ8MTXP01DKJJ5.38.4.A04.1.454.CMB.2.raw
  modified_base (329)..(329): a, c, t, g, unknown or other
  modified_base (332)..(332): a, c, t, g, unknown or other
  modified_base (368)..(368): a, c, t, g, unknown or other
  modified_base (520)..(520): a, c, t, g, unknown or other
  modified_base (592)..(592): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcacctttagtaactatttaatgagctgggtccgccagcctccagggaagggctggagtgggtggccagcattaacaagatggaacgtgaaaaaatctatgtggactctgtgaagggccgattcgccatctccagagacaaacgcaagaactcactgtggctgcacatgaacgctagagaggcgacgacacggctgtgtacttngtncgagacgcccccacgtggagggctacaggtggggancttaacgactttgacttacgcgggggacccaacggggaaccctggtaccaccgtcctcctccgacgccctaccaaccgaacgggcccctacgtcggtcccgtttccccctcggcccacccttccaccaacgcgcaccgtcgtcggggcacgngccggcccgttgggccgttcgccgtacggttaacgacgttacttccaccgtcgtagcgttaccgtaacgggnggtcgg

SEQ ID NO: 398303 - DNA, 542 bp, Homo sapiens
  misc_feature: GZ8MTXP01ETTW9.38.4.A04.1.454.CMB.2.raw
  modified_base (207)..(207): a, c, t, g, unknown or other
  modified_base (333)..(333): a, c, t, g, unknown or other
  modified_base (379)..(379): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgngggggaggcttggtccgaggcccgggggggtccctgagactctcctgtgcagcctctgcattcacctttagtaactatttaatgagcgtgggtccgccagccctcgagggaggggctggagtgggnggccagcattaaccaagatggacgtagaaaaatctatgtgactcgngtgagggccattcgccatctcagagacaacgacaaagactacactgtgctagcacataggaacggccagacgacggcgacgacacggtctgtgtaacttgttgtgcgacggcccacccccgagttcggaagggctaacgagggtgggatcgttaacgttaacg

SEQ ID NO: 398304 - DNA, 648 bp, Homo sapiens
  misc_feature: GZ8MTXP01BVBFJ.38.4.A04.1.454.CMB.2.raw
  modified_base (312)..(312): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcgttggtccgagggcccggggggtccctgagactctcctgtgcagcctctgctacttctacctttagtaacttatttaatgagtcgtcgggtcccnccagcccgtccgaggggaggggctggaggtgggtgcccagctaattaaccgaagatggaaccgtagaaaaatctagtgtaagtactgtgtacggaagggcctagttcgcctatcctacgagacgacaaccgaccgaaagaactcacgtggtacgctagccaacgagtacggaaccggccgtaggacggacgggacgaaccggacgaccgggtccgttggttcgtaaccgtttcgttaggtcgaccggacggacccgaccccccgttagacggggtaacgggtaccgttaacggacgggtcgggggttacgtaacccggtttaacggtttaacccgg

SEQ ID NO: 398305 - DNA, 647 bp, Homo sapiens
  misc_feature: GZ8MTXP01BRQAQ.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcgttgggtccgagggcccgggggggtccctggacgtactctcctgtgcacgccctctgctattcctaacctttagtaaacttatttaatgacgtcgtcggtcccgccagccctccggagggaggggctgggaggtggggtcgcccagctaacgttaaaccaaggtagtaggaaccgtaaggaaaaaatcgtagtggtaacgactcgtgtacggaagggccgtattccgctactcctacgaagacgaacaacgaccaaacgactcacgtggtcgctagaccaacggagttacggaaccggtccgtaggacggcgggaccgaaccgacgtaccggtcgtggtcgttaacttcgttgtacgccgacgacccgcccccgttagttacgggaacggtcgtaacgagggtcgggttacgtaaccgttaacggttaacg

SEQ ID NO: 398306 - DNA, 576 bp, Homo sapiens
  misc_feature: GZ8MTXP01BT95V.38.4.A04.1.454.CMB.2.raw
  modified_base (252)..(252): a, c, t, g, unknown or other
  modified_base (258)..(259): a, c, t, g, unknown or other
  modified_base (262)..(262): a, c, t, g, unknown or other
  modified_base (278)..(278): a, c, t, g, unknown or other
  modified_base (306)..(306): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagcgtggtttcgtgtagcgtatttagaaggtgtccagtgtgaggtgcaacgtggtggagtcgtgggggagcttgggtccaggcggggggtccctgagctctctgtgcncgctcnnctntctactatatatatgngcgtcggcgcgcgtcgtcgagggagggnggtggtaggtgggtcggcgacgactaactaacgaagagtacggtaagtaagtaaacgtaactagtagtacgtcgtagtagtaggacggacgtacgtcgactactctacgacgacgaacgacgacgaacgtactacgacgtcgtacgtcgtacgacgacgtacgtacgacggcgagacggacggacgacgtacgacgcgtgtcgtcgttcgtcgttcgcgcgccgccgttacgtggacggtaacgtacgacggttacggtcgttcgtaacg

SEQ ID NO: 398307 - DNA, 568 bp, Homo sapiens
  misc_feature: GZ8MTXP01APY1D.38.4.A04.1.454.CMB.2.raw
  modified_base (178)..(178): a, c, t, g, unknown or other
  modified_base (290)..(290): a, c, t, g, unknown or other
  modified_base (304)..(304): a, c, t, g, unknown or other
  modified_base (498)..(498): a, c, t, g, unknown or other
  modified_base (529)..(529): a, c, t, g, unknown or other
  modified_base (545)..(545): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtntccagtgtgaggtgcaactggtggagtcgtgggggagcttggtccgagggcccggggggtcctgagactctctgtgcagcctctgctattcaacctttagaacttatttaangagctgggtccccncgacgccgacggagggagggcgtgggaggtcgggcgacgagactaaagtaaacgaagagtaggaaccgtaagaaaactgtagtcgtaacgactgtggacgacggccgtatccgactactccacagacgaacaacgacaagactgacgtcgcgcacgacacggacgacgaccgcgagacgcgacgacgacgcgtntcgtgtctcgttgcgccgacgcccgacccgnggcggcgtacgaaggnggtcggactaacgttaacgtaag

SEQ ID NO: 398308 - DNA, 747 bp, Homo sapiens
  misc_feature: GZ8MTXP01CFKNP.38.4.A04.1.454.CMB.2.raw
  modified_base (321)..(321): a, c, t, g, unknown or other
tcagtcgatcacgtcacgaccggtgctcgatttagagtagtgatcaggggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggcgttggtccgagggcccgggggggtccctggacgtactctccgtgtcgcacgtcctctgctattcctacctttagtaacttattaatgacgcgtcggtccgcncgccgtccgaggggagggtcgtgggaggtggggtcgaccgagactaaacttaaaccgaaaggtagtacggaacccgtaaagtaaaaaatctaagtggtaacgtactcgtaggtacgggaaacggggtcctacgttccgacctacttaccgaccgaacggaacgaacccaaaccggacccaaaacggtaacccttaccgaccgttgggtacgggtccttacggaccaacggtaacgttacggggaaacccggtcccgtaaggaaccgggacgggaaccggtaaacccggtacggaaccgggttccttaggttccgttaaccgtttcgttacgggtaccggcggtaaaccgccccggacccccgagggttcgggaacgggtacctaacgggacggtcggggaaccgttcgttaacccggtttaaccgg

SEQ ID NO: 398309 - DNA, 854 bp, Homo sapiens
  misc_feature: GZ8MTXP01B7JIQ.38.4.A04.1.454.CMB.2.raw
  modified_base (263)..(263): a, c, t, g, unknown or other
  modified_base (282)..(282): a, c, t, g, unknown or other
  modified_base (303)..(303): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccgagggaaggggctggagtgggtgccagcattaaccaagatggacgtagaaaaatctatgtggactctgtgaagggccattcgccatctcaganacaacgcaagactcactgnggctgcacatcgaacggtccngagaggccgacgacgacggtctgtacgtactttcgtggtgcggacgaccgccccccacgtggacgggtctacggaggtgggacgtcctaacggtacgtttcgaaccgttaaccgggtcgggggaccccgtaacgggggtaaccccttcgggttacccgtaccccggttccttaccccgtccgtaaacccggtcccccgttaaccccgaaaccccgggtaaccggggacccccgtaaccggtttccccggggtttacccccccgtttacccccccggggtcccggggtaccccccttaaacccccccggtttaccccctaacccggtaaaacccgggtacccggccccgttaaacccccgggtttcccgggggtaccggggggggtacccctaacccgggaacccgggggttccccggggcccccgggtttacggggggcccctttccggggaccccggttcggggttacccgttaaaccgggttaccccgtttaacccgtttcccggaaccggtttacgacgtttcccgaacggttcgggtaacccggggg

SEQ ID NO: 398310 - DNA, 613 bp, Homo sapiens
  misc_feature: GZ8MTXP01BGXK1.38.4.A04.1.454.CMB.2.raw
  modified_base (283)..(283): a, c, t, g, unknown or other
  modified_base (365)..(365): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgcaagaactcactgngctgcacatgaacggcctgagaggcgacgacacggctgtgtacttctgtgcgagcgcccccactggaggctacgagtggganctacgtactttgactacgtcggggccacgggaccctcggtaccaccgtctcctcacgccctccaccgaacgggcccactccggtcccttcccccgtcggtcccacccctccctaccaacgacgccgacctccgtgggggaccacgcgcccgggtcccgttcgggccgttcggcccgtgggttaccgaaacgggttacccttaaccgtttcccgaacgttacgacgttccggaaccgttgggaaccggg

SEQ ID NO: 398311 - DNA, 663 bp, Homo sapiens
  misc_feature: GZ8MTXP01DPREM.38.4.A04.1.454.CMB.2.raw
  modified_base (275)..(275): a, c, t, g, unknown or other
  modified_base (330)..(330): a, c, t, g, unknown or other
  modified_base (624)..(624): a, c, t, g, unknown or other
  modified_base (640)..(640): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagtcttgggttttccttgttgcttattttagaggtgtccagtgtgaggtgcaacgtggtggagtcgtgggggagcgttgggtccgagggcccgggggggtccctggacgacttctcctggtgcacgtcccttntgttacttcctaaccttttaagtaacttatttaaatgacgtcgtcggggtccccnccgagtcccctaccggaaggggggtacggggtccgtggggtagggtcggggtcggaccaggactaaacgttaaccaaagtagtaggaacgtaaagaaaaattcgtaagtggtagtaaacctgtgggtacggaaacggggctaacgttccgactaatccctacgaagacaacgaaccgaccaaagacttccgagtcggtacggcctaggacaacgtagggtacggaacggtccgagacggcggaccgtacgacgcgtgttcggtcttcctgttgcggaccgacgcccgaccccgngttggacggctagggnggtcggattaccgtaagttcgtg

SEQ ID NO: 398312 - DNA, 770 bp, Homo sapiens
  misc_feature: GZ8MTXP01BOP0K.38.4.A04.1.454.CMB.2.raw
  modified_base (265)..(265): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctatttagaaggtgtccagtgtgaggtgcaactggtggagtcgtggggggagcttggtccgagggcccgggggggtccctggagactctcctgtgcagcctcngcattcacctttagaactatttaatgagtcgtcgggtccgccacgccctaccgaggggaaggggctgggaggtggggtggcccagcgaattaaaccaaggagtaggaaccgtaggaaaaaatctagtggttaagggaaccttcgtaggtacggggaaacggggtcccgtaagtttccggccctaacgttaccctacccgaaagggaacgtaacccgaaaccgacccgaaaacggtaaacccttaccgtaacccgttagggttacggggccttacgggacccaaaccggtaagttacggggaaaccccgggtcccgtaaggggaacgggaccgggaccggaaaccggtaaccggacccggggtaccgttgggttccggttaacttttccgggttgggttacgggaccgggtaacggaaccccgcccccccggttaagttccggggaacggggtaccgtaaccgaacgggggttggggaccgttaaccgttaaccgggtttaaccgg

SEQ ID NO: 398313 - DNA, 618 bp, Homo sapiens
  misc_feature: GZ8MTXP01BBREN.38.4.A04.1.454.CMB.2.raw
  modified_base (263)..(263): a, c, t, g, unknown or other
  modified_base (282)..(282): a, c, t, g, unknown or other
  modified_base (321)..(321): a, c, t, g, unknown or other
  modified_base (333)..(333): a, c, t, g, unknown or other
  modified_base (374)..(374): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcaattaaccaagatggacgtagaaaaaatctatgtggactctgtgaagggccattcgcatctcaganacaacgcaagactcactgnggctgcacagtcgaacgcctggagaggcgacgacacggntgtgtacttcgngtgcgacgccgcccccagtggacggctacgaggagggtacnctacgtacgtttacgacgtacggtcgggggacctaacgggtaccctcggtacctaccgttctccgtcgacgccctaccaccgaacggcccctacgtccggttccccttccccggtcggaccctacccctccgtaccgaaacgcgccgtacccgtcggtcggggaccacgcggccgccgttcggcttcgcccgtggacgacggttccttaaccttcgccgtgacgttcgtaacgttcggaacggg

SEQ ID NO: 398314 - DNA, 769 bp, Homo sapiens
  misc_feature: GZ8MTXP01B4KA0.38.4.A04.1.454.CMB.2.raw
  modified_base (309)..(309): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaggtgtccagtgtgaggtgcaactggtggagtcgtgggggagcttgggtccgagggccgggggggtccctgagactctcctgtgcagccctctgctattctacctttagtaaactatttaatgagtcgtgggtcccnccagccctcgaggggagggcgtggagtgggtggccagcattaaccgaagagtggaaccgtagaaaaaattcgtaatcggtaagggacttcgtagggtacgggaaacggggtcccgtaagtttcccggacctaacttccctacccgaaggaaccggaaccgaaacccggaacccgaaaacggtaacccttaccgtaaccgttcgggtacggtccgttacggaccctaacggtaacggtaaccggaaaccgggggtaccccgttaaggggaacgggaccggggtacccggaaaccggacccggtaaccgggtccgtttacgggtttacggtttaacccgttttccggttcgggtacggacggaaccggacccggaccccccccgttaggttaccggggaaccggggtaccgttaaccggtaggggtacgggggttacgtaacccgttaaccgggtttaaccg

SEQ ID NO: 398315 - DNA, 649 bp, Homo sapiens
  misc_feature: GZ8MTXP01CXJAE.38.4.A04.1.454.CMB.2.raw
  modified_base (353)..(353): a, c, t, g, unknown or other
  modified_base (623)..(623): a, c, t, g, unknown or other
tcagtcgatcacgtcacgaccggtgctcgatttagagtagtgatcagggggaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtggggggaggtcgttgggtccgacgggcccgggggggggttcccctggacggtaccttccgtcccgtggtcgccacggtccccttctcggcctactttcctaaccctttaagtaaaccttatttaaatggagtcgtcgggtccnccacggccctccgagggggaacggggctgggaggtggggtcgcccaggctaagttaaaccagagtacgggactaaagaaaatctataggtgctcgtggtaggaagggccgattccgccatcctacagacgaaccaacgaccaaacgaactcactgtcgctcgacacagtacgaacggccgtagacggaggaccgacgaccgacggtctggtcgttacttccgtggttcggaccgacggacccgcccccgaggtcgggacgggtctacggnggttacggggtcgttccgttaaccgg

SEQ ID NO: 398316 - DNA, 611 bp, Homo sapiens
  misc_feature: GZ8MTXP01DFG0Z.38.4.A04.1.454.CMB.2.raw
  modified_base (262)..(262): a, c, t, g, unknown or other
  modified_base (282)..(282): a, c, t, g, unknown or other
  modified_base (321)..(321): a, c, t, g, unknown or other
  modified_base (328)..(328): a, c, t, g, unknown or other
  modified_base (517)..(517): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcaattaaccaagatggacgtagaaaaatctatgtgactctgtgaaggccattcgcatctccaganacaacgcaagaactcactgnggctgcacatgaacggctgagaggcacgacacggctgtntacttcngtgcgagacgcccccagtggacggctacgaggtgggactcgtacgacttttgacctacgtcgggggaccaacgggaaccctggtccaccgtctcctcacgcctaccaccgaacgggccctatccggtacccttccccggtcggccctacccctcctaccaacgaccgccaacccgtcgtcgggggaccncgacggcccggccgttcgggccttcggcccgtggttaccgaagggttacccttaacgtcccgtaacgtcgacgttcgaaccgttgggaaccggg

SEQ ID NO: 398317 - DNA, 738 bp, Homo sapiens
  misc_feature: GZ8MTXP01A90H8.38.4.A04.1.454.CMB.2.raw
  modified_base (297)..(297): a, c, t, g, unknown or other
  modified_base (309)..(309): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggagtcttgggtccgaggcccgggggggtccctggagacctctcctgtgcagcctctgcattcaccttagtaactatttaangagctgggtccncagcctccgaggggacgggctgggacgtgggtgcccaggcaattaaaccgaagtatacgggacgtagaaaaaacttcgtagtaggtacgggaacttcgtgggttacgggaaacggggtccccgtaagtttcccggacccaactttcccgtacccgaaggtaacgaaacccgaaaacccgggaccccaaaaggaacccttaccgtaaccgttagggttcgggccttacggaccaaacgtaacgttacgggaaacccgggcccgttaggaacggaacggggaccgaaccggttaaccgaacgggtcctggttaacgttaaccgtttccgtgggttcggaccgggaaacgcccggttcccccccgaggttaacggggacgggtaaccgttaaccggaggggtttacgggggaacttaaccgtttaaaccggg

SEQ ID NO: 398318 - DNA, 605 bp, Homo sapiens
  misc_feature: GZ8MTXP01BZUSC.38.4.A04.1.454.CMB.2.raw
  modified_base (258)..(258): a, c, t, g, unknown or other
  modified_base (284)..(284): a, c, t, g, unknown or other
  modified_base (577)..(577): a, c, t, g, unknown or other
  modified_base (587)..(587): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggagcttggtccaggccggggggtcctgagactctcctgtgcagcctntgcattcaccttagaacttatttaangagctcgggtccgccagcctaccgaggggaaggggctagggacggtggggtcggcccgaggctaattaaaccgaagtacgtacgggaacgtaagaaaaaattcgtagtagtggtaacctgtaggtaggaaacggggtcccgtaatttccggaccctagtcctaccgaagacgaaccgaaacgaccaaacgaacttacaaccgtgtaggcctaggaccaacagttagaaaccgggcctagagacggacgacgtacgacgctgtaagtcttcgtgttgcgagcgccccttagcgngggctacggnggttggtcgttcgtaacg

SEQ ID NO: 398319 - DNA, 653 bp, Homo sapiens
  misc_feature: GZ8MTXP01DA6QY.38.4.A04.1.454.CMB.2.raw
  modified_base (293)..(293): a, c, t, g, unknown or other
  modified_base (308)..(308): a, c, t, g, unknown or other
  modified_base (579)..(579): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagtcttggccgagggcccggggggtccctggagactctcctgtgcagcctctgctattcacctttagtaactatttaangagtcgtgggtcccncagccctaccggaggggaggggcgtgggaggtcggggtcgcccgaggactaaacgttaaaccgaaggagtacggaaccgtaagaaaaaacttctaagtggtaacgtaccttggtaggtaggaaccggggtccgtacgttccgactactcctaccgaagacgaacaaccggtacaaagtacctactacgttaggcggtcagacaacgtacgtacgggtaaccggccgaggaacggaggtccgaacgcgtacggtctggttacttaacttcgngtacggacgtaaccgcccgccccgttgttacggaaggacttaacggagggttcgggactcgttaacgttaacgg

SEQ ID NO: 398320 - DNA, 584 bp, Homo sapiens
  misc_feature: GZ8MTXP01CY6L4.38.4.A04.1.454.CMB.2.raw
  modified_base (282)..(282): a, c, t, g, unknown or other
  modified_base (327)..(327): a, c, t, g, unknown or other
  modified_base (335)..(335): a, c, t, g, unknown or other
  modified_base (365)..(365): a, c, t, g, unknown or other
  modified_base (375)..(375): a, c, t, g, unknown or other
  modified_base (504)..(504): a, c, t, g, unknown or other
  modified_base (521)..(521): a, c, t, g, unknown or other
  modified_base (536)..(536): a, c, t, g, unknown or other
  modified_base (541)..(541): a, c, t, g, unknown or other
  modified_base (581)..(581): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaaatctatgtggactctgtgaaggccattcgcatctccagagacaacgcaagaactcactgnggctgcacagtgaaccggctaggagaggcgacgacacggtctgtnttacttcngtgcgagccgcccccatggacgggctacgnggtagggacncgtacgtacgtttagaccgtacggtcggggccgaacgggtacccgtcggtccaccggtctcctcgacgccctaccaccgacggccctacgtccgttccctccccgtcggaccctccctccaccaacgcncgtacctcgcggggccncgtcgccggtccggnggtcncgtccgtgacgcgacctctccgaacgtcgacgttcgtcgngcg

SEQ ID NO: 398321 - DNA, 658 bp, Homo sapiens
  misc_feature: GZ8MTXP01BC9AZ.38.4.A04.1.454.CMB.2.raw
  modified_base (278)..(278): a, c, t, g, unknown or other
  modified_base (330)..(330): a, c, t, g, unknown or other
  modified_base (428)..(428): a, c, t, g, unknown or other
  modified_base (453)..(453): a, c, t, g, unknown or other
  modified_base (487)..(487): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggagcgttgggtccgaggggcccgggggggtccctggacgtacctctccgtgtcgcacgccctcngctattcaacccttttagaaacttatttaaagtgaacgtcgtcggggtcccnccctacgcccgtccggaagggggaagggtctggggaggtggggtcggccagctaattaaaccgagagtggaaccgtagaaaaatcgtatgtaggactntggagaacgggctattcgctatccncagacgacaacgcaaaggactcactggacgctanacacgacgtaggaaaccgccgaggaacggaggccgaacggtacccgaggtccttcggttacgttaaccgttcggttcggtacggccggaacgtaccccgacccccgttgttacggggaaccggtctaacgggtggggtacgggttacgtaaccgttaaccggtttaaccgg

SEQ ID NO: 398322 - DNA, 702 bp, Homo sapiens
  misc_feature: GZ8MTXP01AYK50.38.4.A04.1.454.CMB.2.raw
  modified_base (256)..(256): a, c, t, g, unknown or other
  modified_base (280)..(280): a, c, t, g, unknown or other
  modified_base (365)..(365): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcaccttttagtaactatttaatgagctgggtccgccagcctccgagggaagggctggagtgggtggccagcaattaaccaagatggacgtagaaaaaatctatgtgactctgtgaggccatcgcatcncagagacaacgcaagactcactgngctgcacagtgaacgctagagacggcgacgacgacgctgtgtacttctgtgacgacgaccgcccccagtggacgggtctaacggnggtaggacgtcgtaaccgtcttacgaaccgttacgggaccggggtaccgtaaccgggtacccgtcggtacccgtacccgtcccgtacccgtacgacccgtccctacccgaacccggaccgggtcccgtaccgttcccgttccccgttccccggtccgtcccctaccccgtacccgtaaccgaacgccgtaccgtaccgtccggggtcggggaccaccgggccgggcccgggtcccggttcgggtacccgttccggtaccgtacgggttaaccgttaaccggttacccttaacccgtaccgtaacgtacggtaccgttaccggtaacgttcgggcggg

SEQ ID NO: 398323 - DNA, 726 bp, Homo sapiens
  misc_feature: GZ8MTXP01BGKC1.38.4.A04.1.454.CMB.2.raw
  modified_base (263)..(263): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgccagtgtgaggtgcaacgtggtggagtcgtgggggagcttggtccgagggcccggggggtcctggacgactctctgtgcagcctngcattcacctttagaactatttaatgagtcgtcgggtcccgccgacgccctccggaaggggaacgggggtctagggggaggtgggggtcggcccgaaggtactaaactttaaacccgaaagagtacgggaaacccgttaaggaaaaaattcgtaagttggtaacggtaacttcgtaggtacgggaaacggggtccgtaagttcccggacctactcccgtaccgaaggaacgaaccaaccggacccaaaacggtaacctccaacgttggacgtcgtacgaccacggttaacgacggaaacccgggtcctaagggaacggacgggaccgaaccggacgaccggtacgtcggttgttaacccttgttgggtccggacggaaccggtacccgcccccccgaggttacgggaacggggtaccgtaaccggtaagggcggggacgtaaccgttaaccggtttaaccggg

SEQ ID NO: 398324 - DNA, 717 bp, Homo sapiens
  misc_feature: GZ8MTXP01CJQEZ.38.4.A04.1.454.CMB.2.raw
  modified_base (681)..(681): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcgttggtccgaaccggggggtccctggacgactctcctgtgcagcctctgctattcacctttagtaactatttaatgacgtcgtcgggtcccgccgaagtccccgtaccggagggggaaacgggggtctgggggacggttcgggggtggcccaaggtctaaagtttaaacccgaaaggaacgttcgggaaaccgttaaacggaaaaaaacttacgtaagtacggtacgggtaaccttacggtggtacgggaaacgggggtccactttccggacccagttacccaccgaaggaaccgaaccaaaccggaccaaacggtaacctcgacctgggttacgcgtacgacaccgaacgggtacggaaaccggccttaggaacggacggccgaaccgtacgaacggtcttaggttcgttaccgttcgtggttcggaccgacgaacccgtccccgagttcggacgggtcctagngggtcggacgttacgtaacgttaaccgtttaacggg

SEQ ID NO: 398325 - DNA, 631 bp, Homo sapiens
  misc_feature: GZ8MTXP01AQ0Q9.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccgacgggcccgggggggtccctgagactctcctgtgcagcctctgctattctacctttagtaacttattaatgagcgtcggtccgcagcctcgagggacgggctggagtgggtgccagctacttaacaagtataggaaccgtaagaaaatctagtgtagactcgtgtaggaacgggcgtagttccgactactcctacgagacgaacgaacgaccaaacgactcacgtgtcgctcgacaacgacgtcggaaacggtccgtagaacggacggaccgaaccgacgacggtcgttcgttacgttaaccgttcgttggtcgaccgaacggaccccgttcccccgaaggttcgggaaccgggtccgttaaacgggcggggttacggggaccgtcccgttaaccggtttaaccgg

SEQ ID NO: 398326 - DNA, 766 bp, Homo sapiens
  misc_feature: GZ8MTXP01CFE7A.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtgccagcattaaccaagatggacgtagaaaaatactatgtgactctgtgaaggccgattcgcatctcagagacaacgcaagactcactgtgctgcacagtcgaacggcctaggaggacggacgacgacgacggtcttggttcgttactttcgtggtcggacgaacggacccgaccccccgtaagtcgggacggggtacctaacggagggtacggggacgtccgtaacgttaacctttagggaaccgtacgggtcgggggaccgaaaccggggtaaccccgttgggtaccctacccggttccttacccgtcgaaccggtcccctacccgaaccggaaacccggggtcccctaacggttccccgggttaccccctttcccccgggccgggtacccctacccccgttaccctaacccgaaaccgaccgacccgtaaccccgttcggggtaccgggggccaaccggccgggtccccgggccgttcggggtccttcggacccgttcgggaaccgttaacgggttacccttaacccgttacctaacggtacgtacgttacccgtaacggttcgggaaccgggg

SEQ ID NO: 398327 - DNA, 567 bp, Homo sapiens
  misc_feature: GZ8MTXP01BQNRN.38.4.A04.1.454.CMB.2.raw
  modified_base (261)..(261): a, c, t, g, unknown or other
  modified_base (267)..(267): a, c, t, g, unknown or other
  modified_base (287)..(287): a, c, t, g, unknown or other
  modified_base (310)..(310): a, c, t, g, unknown or other
  modified_base (367)..(367): a, c, t, g, unknown or other
  modified_base (376)..(376): a, c, t, g, unknown or other
  modified_base (546)..(546): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgaggggaaggggctggagtgggtggccagcattaaccaagatggacgtagaaaaatctatgtggactctgtggaagggccattcgccatcnccaganacaacgcaagaactcactgnggctgcacatgaacggcctgagnggcgacgacacggctatgtactttcgtgtgacgagacgccccccatggaggctacgnggtagggancgtacgtactttgactacgcggggccacgggaccctggtccaccgtctcctcacgcctcaccgacggccacgtcgtcccttcccgtcggaccctacccctccgaccaagcgcctaccgtcgtcgggggccacgcggccggccgttgggcttcgccgtgcgacggctctcncgtgacttcggcgttggcggg

SEQ ID NO: 398328 - DNA, 718 bp, Homo sapiens
  misc_feature: GZ8MTXP01C9MY4.38.4.A04.1.454.CMB.2.raw
  modified_base (265)..(265): a, c, t, g, unknown or other
  modified_base (279)..(279): a, c, t, g, unknown or other
  modified_base (303)..(303): a, c, t, g, unknown or other
  modified_base (330)..(330): a, c, t, g, unknown or other
  modified_base (339)..(339): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccgagggaaggggctggagtgggtgccagcattaacaagatggacgtagaaaatctatgtgactctgtagaggccattccgcatctcagagacaacncaagaactcactgnggctgcacatcgaacggcctgagnggacgacgacgacggctgtgtacttcngtgcgagcncccccatggaggctacgaggtacgggagtcgtaacgtacgtttacgaccgtacggtcgggggacccgacggggtaaccccgttcggtaccaacccggttcctccccgtacacccgtccccgtaccccaacccggtaaccggtacccctaacggttccccgggttccccctttaccccccggggtccggtccccctaacccccgttcccctaaaccccgaacggccgacccggtaacccgtccgggtacgggggcccaccgtaccgggcccggtcccggttcgggtcccgttcggtacccgttcggttacgttaaacgggttaccctttaaccgtacccgtcggtacgaccgttacgtaaccgggttaacggtccggggg

SEQ ID NO: 398329 - DNA, 607 bp, Homo sapiens
  misc_feature: GZ8MTXP01DGJ08.38.4.A04.1.454.CMB.2.raw
  modified_base (295)..(295): a, c, t, g, unknown or other
  modified_base (308)..(308): a, c, t, g, unknown or other
  modified_base (367)..(367): a, c, t, g, unknown or other
  modified_base (555)..(555): a, c, t, g, unknown or other
tcagtcgatcacgtcacgaccggtgctcgatttagagtagtgatcaggggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggaggcgttggtccgagggcccgggggggtccctgacgactctcctgtgcagcctctgcattcacctttagaactattaangagcgtgggtccncagcctccgaggggagggctggagtgggtgccagctaattaaccaagatggaaccgtanaaaaatctatggtaggactcgtggtaggaaacgggcctattccgccatcctaccgaagacgaacgaaccgaccaaagaacctcaacgtgtcgctagacacgagtcggaaaccgccgtaggacggacggcggaaccggacgtaacgggtctaggtcgttaacttcgttgtcggcgacgccgacccccgngttcggaacgggactaacggtagggtcgggacgtccgttaacgtttaaccgg

SEQ ID NO: 398330 - DNA, 614 bp, Homo sapiens
  misc_feature: GZ8MTXP01BDABH.38.4.A04.1.454.CMB.2.raw
  modified_base (269)..(269): a, c, t, g, unknown or other
  modified_base (297)..(297): a, c, t, g, unknown or other
  modified_base (309)..(309): a, c, t, g, unknown or other
  modified_base (533)..(533): a, c, t, g, unknown or other
  modified_base (584)..(584): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggaggcgttgggtccgaggcccgggggggtccctggagactctcctgtgcagcctntgctattctaccttagtaactatttaangagctcggtccnccagcctccgaggggagggctgggaggtgggtgccagctaataaccaagatacggactaagaaaatctagtaggtaggaactgtggtaggaacggggccgtagtcgacctatctaccgagacgaacaacgacccaaagacctacacgtagtcggactcggacaacgagtacggaaccggccgtagaggacggaccgacgaccgacggtctggtcgttacttcgngttcggaccggagaccccggcccccaggtcgggacgggtaaccttaacggnggggttacgggaacgttcccggttaaacgg

SEQ ID NO: 398331 - DNA, 570 bp, Homo sapiens
  misc_feature: GZ8MTXP01DYJ7L.38.4.A04.1.454.CMB.2.raw
  modified_base (305)..(305): a, c, t, g, unknown or other
  modified_base (503)..(503): a, c, t, g, unknown or other
  modified_base (510)..(510): a, c, t, g, unknown or other
  modified_base (547)..(547): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcgttgggtccgaggcccgggggggtccctgagactctcctgtgcagcctctgctattcaccttagtaactatttaatgagctgggtccncagcctccgaggggacggggctggaggtggggtcgccagctaagttaaaccaaagtagtacggacgtaagaaaaatctaagtgtaggctcgtggtagaacggggcctattccgcctatctacagagaccaacgacaaagactcactgagctgcacagtacggaacggcctggagaggaccgaacgacgacggctggtnttcgttntcggttgcggacgccgccccagtggacgggctacggnggttcgggaacgttcgtaaccgg

SEQ ID NO: 398332 - DNA, 635 bp, Homo sapiens
  misc_feature: GZ8MTXP01BX8SH.38.4.A04.1.454.CMB.2.raw
  modified_base (261)..(261): a, c, t, g, unknown or other
  modified_base (280)..(280): a, c, t, g, unknown or other
  modified_base (288)..(288): a, c, t, g, unknown or other
  modified_base (299)..(299): a, c, t, g, unknown or other
  modified_base (310)..(310): a, c, t, g, unknown or other
  modified_base (314)..(314): a, c, t, g, unknown or other
  modified_base (320)..(320): a, c, t, g, unknown or other
  modified_base (352)..(352): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtcccgccagcctccgagggaagggctggagtgggtggccagcattaaccaagatggacgtagaaaaatctatgtgactctgtgaaggccattcgcatctcaganacaacgcaagactcactgngctgcacntgacgctgagngcgacgcacgntgtntacttntgtgcgacgacgccccctagtggaggctacgngtagggactcgtacgtactttgaccgtacggtcgggggacctaacgggaccctggtacctaccggtctacccgtcacggcccttaccgaaccgtaacgggcccctacggtccggttccccttccccgggtcggaccctaaccccttcccgtaccgaaacgccgtaccacccgttcggtaccgggggccacgcccggtcgggccccgttgggggtccttcgtcccgtaggttaccgacgggttaccttaacttccgaagttcacgttcgtaacgttggaacggg

SEQ ID NO: 398333 - DNA, 802 bp, Homo sapiens
  misc_feature: GZ8MTXP01AMTYK.38.4.A04.1.454.CMB.2.raw
  modified_base (287)..(287): a, c, t, g, unknown or other
  modified_base (299)..(299): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcttggtccgaggccggggggtccctgagactctcctgtgcacgcctctgctattcacctttagaactattaangagcgtggtccnccagccctcgaggggagggctggagtgggtgccagctattaaccaagagtaggaaccgtaagaaaattctaagtgtacgggactcgtaggtacggaacggggtccgtagtttcccgacctaacgttccctacccgaacggaaacgaaacccgaaaccggaacccaaaacggtaaacccgttaccgtaacccgttgggtacgggtccttacggacccgaaaccggtaacgttaaccggggaaacccgggtccccgttaaggggaaacgggaaccggggaacccgggaaacccgggaacccggtaaccggggttacccgtttgggtttaccgggtttaacccgttttccggttacggggttccgggaaaccgggtaacccgggtaaaccccgggcccccccccgttaagggttacccggggaaccgggggttaacccgtaacgggtaacgggggttacgggggttaaccggttaacccggtttaaaacccgggttttaacccggg

SEQ ID NO: 398334 - DNA, 652 bp, Homo sapiens
  misc_feature: GZ8MTXP01DMBM1.38.4.A04.1.454.CMB.2.raw
  modified_base (285)..(285): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccaggggaagggctggagtgggtggccagcaattaaccaagatggacgtagaaaaaatctatgtggactctgtgaagggccattcgccatctcagagacaacgcaagaactcactgngctgcacatgaacgctgagaggcgacgacgacgctgtgttacttctggtgcgacgccgccccccagtcggagggtctaacgaggtaggggactcgtaacgtaccgtttgaaccttacgggtcgggggccgaaacggggtaaccctggtaccaccgtctcctcacgccctaccaaccgaacggccctaacgtcccgttccccttcccccggtcggacccctacccctcccgaccaacgaccgcctacccgtcggtcgggggaccacggtacgcccgggtcccgttcggggccttacgtccggtggttaccgaacggttaccttaacccgttacccgaacgttacgacgttaccgtcgttggaaccggg

SEQ ID NO: 398335 - DNA, 702 bp, Homo sapiens
  misc_feature: GZ8MTXP01BXV1Y.38.4.A04.1.454.CMB.2.raw
  modified_base (281)..(281): a, c, t, g, unknown or other
  modified_base (286)..(286): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcaccttttagtaactatttaatgagctgggtccgccagcctcgagggaagggctggagtgggtgccagcaattaaccagatggacgtagaaaaatctatgtggactctgtgaagggccattcgccatctccagacgacaaaccgcaaagactnactgnggctgcacatgaacggcctgagaggcgacgacgacggtctggtgttactttctggtcgacggacgccgcccccctagtcggacgggtctacgagggtacgggtacgcgttaacgtaccgtttagaccgttaccggtcggggggacccgtaacggggtaaccccttgggtacctacccgttcctcccgtacgaccgtccctaccgacccgaacgggccctacgttcccggtcccctttccccggtacggtccctacccccgtccgtaacccgtaacgcgtcccaccgttccggtcgggggaccaccggccggcccggcccggttcgggggccttcggtcccgttacggttacggttaaacgggttaccttaaccgttcccgtcggttaccgagttaccggcgttaacggggtccggg

SEQ ID NO: 398336 - DNA, 655 bp, Homo sapiens
  misc_feature: GZ8MTXP01CJHN3.38.4.A04.1.454.CMB.2.raw
  modified_base (284)..(284): a, c, t, g, unknown or other
  modified_base (333)..(333): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccgagggaaggggctggagtgggtggccagcaattaaccaagatggacgtagaaaaatactatgtggactctgtgaagggccattcgcatctcagagacaacgcaagactcactgnggctgcacatgaacggcctggagaggcgacgacacggctgtgtacttcngtgcgacgaccgcccccaagtggaggggtctacgnggtacgggatcgtacgtacgtttgactacggtcgggggaccacgggtaccctgggtaccacccgttctccctactacgcccctaccgacccgaaccgggtccccaacgttcccgttcccttccccccggtcggacccctaccccctcccgtaccgaaccgccgtaccctacccgtccggtcgggggccacggcgcccggtcccgttacgggcttcggaccgtcgggttaaccgacggttaccttaaccttcccgtaacggtgtacgttaccggtcgttcggccgggg

SEQ ID NO: 398337 - DNA, 710 bp, Homo sapiens
  misc_feature: GZ8MTXP01EOUYY.38.4.A04.1.454.CMB.2.raw
  modified_base (287)..(287): a, c, t, g, unknown or other
  modified_base (300)..(300): a, c, t, g, unknown or other
tcagtcgatcacgtcacgaccggtgctcgatttagagtagtgatcagggggtctcagagaggagccttagccctggactccaaggcctttccacttggtgatcagcactgagcacaggggactcaccatggaattggggctgagctgggtttttccttgttgcttatttagaaggtgtccagtgtgaggtgcaactggtggagtcgtgggggagcttggtccgaggccggggggtccctgagactctctgtgcagcctctgctacttcacctttagtaactattaangagtcgtggtccnccagcctcgaggggaagggcgtaggaggtgggtcggaccaggtactaaactttaaaccgaagtagtacgggtaaacgtaaaggtaaaaaattacttaagtggtagggtaaaccttcgttggaggaaacggggccctaagttcccgacattcccacgacgaacggaacaaccgaccaaagtaaactcgtaactggtcggcacgacgaactacgggttacgggaaaccggtccagggaaacggacggacccggttaaacgaaaccccgggtcggtacgttaggttaccgttacgttcggtacggttccggaccggttaaccggaccccgtaccccggttaggcggggttaaggtaacccgtaagggtaacgggttcgggaacttaccggttaaccggttaacggtttaaccg

SEQ ID NO: 398338 - DNA, 724 bp, Homo sapiens
  misc_feature: GZ8MTXP01B60KO.38.4.A04.1.454.CMB.2.raw
  modified_base (563)..(563): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttctgtctgcatctgtaggggacagagtcaccatcacttgccggccagtcagggcattaggacttgtttacgccgtggtactcgaagaacgaaaaaaccgaagggtaaaccgacccctaaacccgttcctaggacttactaagtcgggtacgcctaagttaccctatttttacggacgtaaaacggttcgggggttacccagttaccgtaagggtttaccacggacccgggtacgtaaggtggtaacgttccggtacgggggaaaataacgggtaactttacaaacgggtccttacaactaactacgaacgtacgacgcccgtcgcgaacggtcccgttaagggaacgacttaacgtgttaacgtaactttaatttaacttcgggttacttaaanacgttacctttaaccgtaaccctttaccccactttaccggttttcgggacccggtacgggggtaaaccctagggttaacggtaacgttaactacgaaaacgtaaccggtggttacggcgttacgtcacaacttccgtgttaccttaacgttccttaacccg

SEQ ID NO: 398339 - DNA, 522 bp, Homo sapiens
  misc_feature: GZ8MTXP02JS9UZ.38.4.A04.1.454.CMB.2.raw
  modified_base (362)..(362): a, c, t, g, unknown or other
  modified_base (475)..(475): a, c, t, g, unknown or other
tcagtcgatcacgtcacgaccggtgctcgatttagagtagtgatcaggggaagaccgatgggcccttggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacaggctgtgtacttctgtgcgagagcccccatgagggctacagtggganctacgactttgactactgggggccagggaaccctggtcaccgtctcctcagcctccaccaagggcccatcggtctcccctgcaccctcctccagacgcacctctgggggcacngcggcctgggctgcctgtcaggactaactccacgtgatcgactgacg

SEQ ID NO: 398340 - DNA, 505 bp, Homo sapiens
  misc_feature: GZ8MTXP02HDMZ2.38.4.A04.1.454.CMB.2.raw
  modified_base (406)..(406): a, c, t, g, unknown or other
  modified_base (416)..(416): a, c, t, g, unknown or other
tcagtcgatcacgtcacgaccggtgctcgatttagagtagtgatcaggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactcgttagcctggtatcagacaaaaaccagggaaacgcccctaactcctgatctatggtgcatccattttgcaaagtgggtccatcaagttcagcgcagtgatcgtggacagattcagtctcacaatcagcagccctgcagcctggacatactgactaacttattattgtctaacngactttaaancgtttacccccatacttttggacctaagggggaccaaggtttcggagtatacgaaaacgactgtgctagcacatctgtcttacattccg

SEQ ID NO: 398341 - DNA, 541 bp, Homo sapiens
  misc_feature: GZ8MTXP02H9UTV.38.4.A04.1.454.CMB.2.raw
  modified_base (267)..(267): a, c, t, g, unknown or other
  modified_base (290)..(290): a, c, t, g, unknown or other
tcagtcgatcacgtcacgaccggtgctcgatttagagtagtgatcagggggagtcagtcccagtcaggacacagcatggacatgagggtccccgctcagctcccggggctcctgctgctctggctcccaggtgccggatgtgacatccagttggcccagtctccatccttcctgtctgcatctggtagggacagagtcaccatcacttgcgggccagtcagggcattaggactcgtttagcctggtatcagcaaaaaccagggaaancccctaactcctgatctatggtncatccattttgacaaaggtcggggtcccatcgaaaggttcaggcggcagtggatcgtggggacaggaattcagttctcacaatcagcagcctgcagcctggagatactgactaacttattatttgtctaactagtactttaaatacgttacccccatacttttcggacctaagggggacctaaaggttcggaagtattaccaaaacgtaacgtgtcggcttgactaaccatctgtctacacttcctccccg

SEQ ID NO: 398342 - DNA, 510 bp, Homo sapiens
  misc_feature: GZ8MTXP02F4WPD.38.4.A04.1.454.CMB.2.raw
  modified_base (296)..(296): a, c, t, g, unknown or other
  modified_base (442)..(442): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactattaatgagctgggtccncagcctccagggaagggctggagtgggtgccagcattaaaccaagatggacgtagaaaaatactatgtggactcgtgtgaaaggggccattcgccatctccagagacaacgcaaagactcactgtagctgcacatgaacgctgagnggcacgacacggctgtgtacttctgtcgcgagacgcccccatgaagggctacgagtggacgcacgtac

SEQ ID NO: 398343 - DNA, 512 bp, Homo sapiens
  misc_feature: GZ8MTXP02FLR66.38.4.A04.1.454.CMB.2.raw
  modified_base (402)..(402): a, c, t, g, unknown or other
  modified_base (464)..(464): a, c, t, g, unknown or other
tcagtcgatcacgtcacgaccggtgctcgatttagagtagtgatcaggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagcctggtatcagcaaaaaccagggaaacgcccctaacctcctgatctatggtgcatccatttgcaaagtgggtccatcaagttcagcgcagtgatctggacagattcagtctcacaatcagcagcctgcagcctggacatactgacaactttattatgtactanagtacttaaataccttaacccccattactttcggaccgtaacgggggacctaaggttcgganatacgaaaacggaactgtacggctagcaaccatctgtcttcacttccg

SEQ ID NO: 398344 - DNA, 590 bp, Homo sapiens
  misc_feature: GZ8MTXP02ILNNT.38.4.A04.1.454.CMB.2.raw
  modified_base (331)..(331): a, c, t, g, unknown or other
  modified_base (366)..(366): a, c, t, g, unknown or other
tcagtcgatcacgtcacgaccggtgctcgatttagagtagtgatcaggggaagaccgatgggcccttggggaggcttggtccagccgggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggcctggagaggcgacgacacggctgtgtacttcngtgcgagacgcccccatgagggctacaggtggganctagactttgactacgtgggggcccaaggggaaccctggtccacccgtctccctcgacgcccctacccaacccgaacggggccccaacgtcccgggtcccttccccctcgggcccacccctccctcccaaagacgccaacctcgtcgggggccacgacggccgggcccctggggcctcggccgtcggtacaaggacctaactcccacgtcgactcgactgacgg

SEQ ID NO: 398345 - DNA, 559 bp, Homo sapiens
  misc_feature: GZ8MTXP02HCW48.38.4.A04.1.454.CMB.2.raw
  modified_base (356)..(356): a, c, t, g, unknown or other
  modified_base (363)..(363): a, c, t, g, unknown or other
  modified_base (494)..(494): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccattcgccatctcagagacaacgccaagaactcactgtggctgcacatgaacggcctgagaggcgacgacacggctgtgtacttctgtgcgagacgcccccatgagggctacgngtggganctacgactttgactacgtgggggaccaggggaaccctggtccaccgtcgtcctcacgccctccacccgaacgggccccagtccggtcccttcccccgtggccacccctcctcccaacgacgccaccttcgngggggccacgacgcggccctgggctgccctggtcaggactaacgtccacgtcgatcgactgacgg

SEQ ID NO: 398346 - DNA, 522 bp, Homo sapiens
  misc_feature: GZ8MTXP02IDIF9.38.4.A04.1.454.CMB.2.raw
  modified_base (270)..(270): a, c, t, g, unknown or other
  modified_base (293)..(293): a, c, t, g, unknown or other
  modified_base (382)..(382): a, c, t, g, unknown or other
  modified_base (387)..(387): a, c, t, g, unknown or other
  modified_base (409)..(409): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagacaaaaaccagggaaacncccctaactcctgatctatggtncatccatttgacaaagtgggtccatcaaggttcagcgcagtgatctggacagattcagtctacacaatcagcagcctgcagcctggagntacgngactaacttattattgtactanatacttaataccgttaccctattacgtttacggacgtaacgggactaaggttcgaagtactaacgaaaacgtacgtgtacgctacgaactactattctgttacttactactcc

SEQ ID NO: 398347 - DNA, 531 bp, Homo sapiens
  misc_feature: GZ8MTXP02JUHIX.38.4.A04.1.454.CMB.2.raw
  modified_base (365)..(365): a, c, t, g, unknown or other
  modified_base (391)..(391): a, c, t, g, unknown or other
  modified_base (476)..(476): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactcgttagcctggtatcagacaaaaaccgagggaaacgccccctaacctcctagatctatggtgcatccattttgcaaagtgggtcccatcaaggttcagcggcagtggatcgtgggacagattcagtctacanaatcagcagccctgcagccgtagganatactgactaaatttattattcgtctacagtacttaaataccgttacccccattacgtttcggacaggggtaccaaggttcgganatacgaaacgtacgtgtcggactgcctaaccttactctcgttactactacttccg

SEQ ID NO: 398348 - DNA, 525 bp, Homo sapiens
  misc_feature: GZ8MTXP02GPMDL.38.4.A04.1.454.CMB.2.raw
  modified_base (429)..(429): a, c, t, g, unknown or other
  modified_base (475)..(475): a, c, t, g, unknown or other
  modified_base (515)..(515): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttggtccaggccgggggggtccctggagactctcctgtgcagcctctgcattcacctttagtaactattaatgagctgggtccgccagccctccgagggaaggggctggagtgggtgccagcattaaaccaagatggaaccgtagaaaaatactatgtggactctgtgaaagggccgattcgccatctccagagacaacgccaaagactcactgngctgcacatgaacggctgagaggcgacgacacggctgtgtacttcngtgcgagccgcccccatggaacggctacgacggtgggacncgtacgtacg

SEQ ID NO: 398349 - DNA, 524 bp, Homo sapiens
  misc_feature: GZ8MTXP02I76LE.38.4.A04.1.454.CMB.2.raw
  modified_base (297)..(297): a, c, t, g, unknown or other
  modified_base (306)..(306): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
  modified_base (315)..(315): a, c, t, g, unknown or other
  modified_base (319)..(319): a, c, t, g, unknown or other
  modified_base (321)..(321): a, c, t, g, unknown or other
  modified_base (352)..(352): a, c, t, g, unknown or other
  modified_base (370)..(370): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcgtgtaggctatttagaaggtgtccagtgtgaggtgcaactggtggagtctgggggaggcttggtccagccggggggtcctgagctctcctgtgcagcctctgcattcaccttagtaactattaattgagctggtcgccagcccncgaggaggngngngnggngcgngnatacagagagacgtagaaatatatgtgactntgtgaggcgatcgcatcncagagacaacgacaacgactacactgtgctgacacagtacgacgacgtagagacggacggacgacgacgcgtcgtagtacgttcgtcgtcgacgacgaccgacccgaccgtacggaacggacgtacgtacggtacgggacggtacgtacgtacg

SEQ ID NO: 398350 - DNA, 761 bp, Homo sapiens
  misc_feature: GZ8MTXP02JG23V.38.4.A04.1.454.CMB.2.raw
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgcatctcagagacaacgccaagaactcactgtggctgcacatgaacggcctgagaggcgacgacacggctgtgtacttctgtgcgagacgcccccagtggacgggctaacgaggtgggacgccgtaacgtacttttcgacgttaccgtcgggggacccaacggggaaaccccgtcgggtaccgtacccggtcccttccccgttccgaccgtcccccgttacccccgaaacccccgaaaccgggggacccccctaacggttccccgggttcccccgtttcccccccggtccggggtaccccctaaccccccgttcccccttaccccgaaacggacccgacccgtaacccccgttccgggtccggggggacccaacccgaacgggcccccggggtccccggtcgggggcccgtcgggtacccgttcgggggttaacccgaaaacggggtacccttaacccgtttaccccggaaccggttacggaaccgttccggaaccggttggaacccgggg

SEQ ID NO: 398351 - DNA, 551 bp, Homo sapiens
  misc_feature: GZ8MTXP02H4RXK.38.4.A04.1.454.CMB.2.raw
  modified_base (268)..(268): a, c, t, g, unknown or other
  modified_base (291)..(291): a, c, t, g, unknown or other
  modified_base (364)..(364): a, c, t, g, unknown or other
  modified_base (389)..(389): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagctggtatcagacaaaaaccagggaaacncccctaactcctgatctatggtncatcctattttgactaaaggtcgggtacccatcaaggttcaggcggcaggtgatcgtgggacagattcagtcnaacatcagcagcctgcagctagganatacagactaacttattattgtacttacagtacttaaataccgttacccccaattaccgtttggacccgtaaggggtaaccctaaaggttaggataactacgaaaacgtaactggtacggctacgaactacctaatccgtagttacctttcaactttccccg

SEQ ID NO: 398352 - DNA, 530 bp, Homo sapiens
  misc_feature: GZ8MTXP02JZ11T.38.4.A04.1.454.CMB.2.raw
  modified_base (369)..(369): a, c, t, g, unknown or other
  modified_base (425)..(425): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactatttaatgagctgggtccgccagcctccaggggaggggctggagtgggtggccagcattaaccaagatggaccgtagaaaaatactatgnggactctgtgaaggggccattcgccatctccagagacaacgcccaagactcactgnggctgcacatgaacggcctaggagaggcgacggacacgggctgtgtacttcgtgtcgcgagaccgcccccagtgaacggggctacgaggtgggacgctacgtacg

SEQ ID NO: 398353 - DNA, 587 bp, Homo sapiens
  misc_feature: GZ8MTXP02IYT91.38.4.A04.1.454.CMB.2.raw
  modified_base (361)..(361): a, c, t, g, unknown or other
  modified_base (370)..(370): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaaggccgattcgccatctccagagacaacgccaagaactcactgtggctgcacatgaacggcctggagagggcgacgacacggctggtgtacttctgtgcgagacgcccccatgagggctacgnggtgggganctacgactttggactacgtgggggccagggaaccctggtccaccgtctcctcacgccctccaccgaacgggcccagtccggtcccttcccccgtcggcccaccccctcctacccaaacgacgccaccgtcgtcgggggacacgacgccggcccgtggggcctcggcctcgggtaccaacgggacttaaccgttccgacgttgactcgacgtgacggg

SEQ ID NO: 398354 - DNA, 559 bp, Homo sapiens
  misc_feature: GZ8MTXP02H32VN.38.4.A04.1.454.CMB.2.raw
  modified_base (260)..(260): a, c, t, g, unknown or other
  modified_base (317)..(317): a, c, t, g, unknown or other
  modified_base (362)..(362): a, c, t, g, unknown or other
  modified_base (379)..(379): a, c, t, g, unknown or other
  modified_base (480)..(480): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaaggccgattcgccatctcaganacaacgcaagaactcactgtggctgcacatgaacggtctgagaggcgacgacacggntgtgtacttctgtgcgagacgcccccatgagggctacagtggganctacgatttgactacgnggggaccagggaaccctggtcaccgtctcctcacgccctccaccgaacgggcccatccggtccttccccctggccacccctcctaccaacgacgaccaccncgtgggggccacgacggcggcccgtcggggctcggccgtcggtcaaggactaacttccgacgtgactccgactggacgg

SEQ ID NO: 398355 - DNA, 533 bp, Homo sapiens
  misc_feature: GZ8MTXP02G5GVA.38.4.A04.1.454.CMB.2.raw
  modified_base (298)..(298): a, c, t, g, unknown or other
  modified_base (396)..(396): a, c, t, g, unknown or other
  modified_base (402)..(402): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactattaatgagctgggtccnccagcctccgaggggaagggctggagtgggtggccagcattaaccagatggaccgtagaaaaatctatgtggactcgtgtgaagggccattcgcatcnccaganacacgccaagacctcactgtgctgcacatagaacggcctaggacgaggcgacgacgtacgggctgtcgtacttcgtgtcgcgacgaccgcccccagtggaacgggctacgaggtggacgtctacgttaccg

SEQ ID NO: 398356 - DNA, 551 bp, Homo sapiens
  misc_feature: GZ8MTXP02FXK2O.38.4.A04.1.454.CMB.2.raw
  modified_base (332)..(332): a, c, t, g, unknown or other
  modified_base (448)..(448): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttcngtgcgagacgcccccatgagggctacagtgggagctacgactttgactacgtggggccagggaccctggtcaccgtctcctcacgcctcaccaagggcccatccggtcttcccccnggccacccctcctccaaacgcgccacccttcgcgggggccacgcgccggcccgtggggctgcctcggtacaaggcctaacgttccacgtcgatcgactgacgg

SEQ ID NO: 398357 - DNA, 560 bp, Homo sapiens
  misc_feature: GZ8MTXP02IKQS8.38.4.A04.1.454.CMB.2.raw
  modified_base (363)..(363): a, c, t, g, unknown or other
tcagtcgatcacgtcacgaccggtgctcgatttagagtagtgatcagggggaagaccgatgggcccttggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggacattcgccatctccagagacaacgcaagactcactgtgctgcacatgaacggcctgagaggcgacgacacggctgtgtacttctgtgcgagacgccccccatgagggctacgagtggganctacgactttgacctacgtggggccagggaaccctggccaccgtctcctcacgccctccaccgaacgggcccagtccggttcccttcccccgtcggttaccccctccctccaacgcgcaccgtcgtcgggggcacgcgccggcccgtgggctcgacgtcggcgaacggctacttccgacgtgactcgactgacgcgg

SEQ ID NO: 398358 - DNA, 517 bp, Homo sapiens
  misc_feature: GZ8MTXP02HK8R6.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactatttaatgagctgggtccgccagcctccagggaagggctggagtgggtgccagcataaccagatggacgtagaaaatctatgtggactctgtgaagggccgattcgcatctccagagacaacgccaaagaactcactgtgctgcacatagaacgcctagagaggcgacgacacggctgtgtacttcgtgtcgcgacgacgcccccagtcgaagggctacgaggtggacgcgtacgtacg

SEQ ID NO: 398359 - DNA, 551 bp, Homo sapiens
  misc_feature: GZ8MTXP02IOHPL.38.4.A04.1.454.CMB.2.raw
  modified_base (362)..(362): a, c, t, g, unknown or other
tcagtcgatcacgtcacgaccggtgctcgatttagagtagtgatcaggggaagaccgatgggcccttggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagcgcccccatgagggctacagtgganctacgactttgactacgtggggccagggaaccctggcacgtctcctcagccctccaccgaacgggcccagtccggtcccttcccccgtcggccaccccctctacccaagacgaccaccgtcgtgggggcacgacgcggcccgtgggcctgcctcggtacaaggctaactccacgtcgatcgactgacgg

SEQ ID NO: 398360 - DNA, 547 bp, Homo sapiens
  misc_feature: GZ8MTXP02HHIAI.38.4.A04.1.454.CMB.2.raw
  modified_base (331)..(331): a, c, t, g, unknown or other
  modified_base (366)..(366): a, c, t, g, unknown or other
  modified_base (385)..(385): a, c, t, g, unknown or other
  modified_base (478)..(478): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctcagagacaacgccaagaactcactgtggctgcacatgaacggcctgagaggcgacgacacggctgtgtacttcngtgcgagacgcccccatgagggctacgagtggganctacgactttgacttacgnggggccagggacctggcacgtctctcagcctccacgaacgggcccagtccggtccttcccccgtggccacccctcctaccaagcgcacctcgngggggcacgacgccggcccgtggggcctgcctggtcaaggactaacgttccacgtcgatcgactgacgg

SEQ ID NO: 398361 - DNA, 571 bp, Homo sapiens
  misc_feature: GZ8MTXP02JM0F6.38.4.A04.1.454.CMB.2.raw
  modified_base (366)..(366): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccatgagggctacgagtggganctacgctttgactagtgggggccagggaaccctggtcaccgtctcctcacgcctccaccgaacgggcccatccgggtccttcccccgtcggcctaccctccctaccaacgacgccaccgtcgtgggggccacgacgccggcccgtgggctcgccgtcggtaccgaacggacctaaccgttccgacgttgacgtcgaccgtgacgg

SEQ ID NO: 398362 - DNA, 520 bp, Homo sapiens
  misc_feature: GZ8MTXP02GUBFN.38.4.A04.1.454.CMB.2.raw
  modified_base (297)..(297): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactattaatgagctgggtccnccagcctcagggagggctggagtgggtgccagcataaccagatggaccgtgaaaaatctatgtggactcgtgtgaagggcctattcgccatctccagagacaacgccaaagactcactgtgctgcacatgaacggctgagaggcgacgacacggctgtcgtacttcgtgtcgcgacgacgcccccagtcggaacgggctacgaggtcgggacgcgtacgtacg

SEQ ID NO: 398363 - DNA, 610 bp, Homo sapiens
  misc_feature: GZ8MTXP02HQL4P.38.4.A04.1.454.CMB.2.raw
  modified_base (333)..(333): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaaagaactcactgtggctgcacatgaacggcctgagagggcacgacacggctgtgtactttcngtgcgagacgcccccatgagggctacgagtggggancgtacgactttgaccttacgtcgggggcctaacgggaaccctggtccaccgtctcctcacgccctaccaccaacgggcccacgtccggttccttccccctggccctacccctcctacccaaagcgcaccgtcgtcgggggcacgacggccggtcccgtggggcctggacccgttcggaccgaacgggacccttaaccgtttcccgaaccgttcggaactttccggaaccgttggaaccggg

SEQ ID NO: 398364 - DNA, 568 bp, Homo sapiens
  misc_feature: GZ8MTXP02IPEIT.38.4.A04.1.454.CMB.2.raw
  modified_base (365)..(365): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgcatctccagagacaacgcaagactcactgtggctgcacatgaacggcctgagaggcgacgacacggctgtgtacttctgtgcgagagcccccatgagggctacagtggganctacgactttgactacgtgggggccagggaaccctgccaccgtctcctcagccctacaccgaacgggcccagtccggtccttccccctggccacccctcctacccaacgacgccaccgtcgtcgggggccacgacggccggcccgtgggcctcggccgtcggtacaaggacctaacgttccaacgttcgaactcgactgacgg

SEQ ID NO: 398365 - DNA, 577 bp, Homo sapiens
  misc_feature: GZ8MTXP02FMIDW.38.4.A04.1.454.CMB.2.raw
  modified_base (237)..(237): a, c, t, g, unknown or other
  modified_base (333)..(333): a, c, t, g, unknown or other
  modified_base (532)..(532): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatactatgtggactntgtgaagggccattcgccatctccagagacaacgccaagactcactgtggctgcacatgaacggctgagaggcgacgacacggctgtgtacttcgngtgcgagacgcccccagtggaggctacgaggtgggagctacgactttgactacgtggggaccagggaacccgtggtacccaccgtcctcctcacgccctaccaccgaacgggccccagtccggtcccttcccccgtggccacccctcctaccaacgcgaccaccgtcggcgggggccacgacggccggcccgtgggtcncggccgtcggtacgaacggactctccacgtgactcgactggacgg

SEQ ID NO: 398366 - DNA, 521 bp, Homo sapiens
  misc_feature: GZ8MTXP02GQX54.38.4.A04.1.454.CMB.2.raw
  modified_base (427)..(427): a, c, t, g, unknown or other
  modified_base (515)..(515): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtcctgagactctcctgtgcagcctctgcattcacctttagtaactatttaatgagctgggtccgccagcctccgaggggaaggggctggagtgggtggccagcattaaccaagatggacgtagaaaaatactatgtggactctgtggaagggccgattcgccatctccagagacaacgccaagaactcactgnggctgcacatgaacggcctagagaggcgacgacacggctgtgtacttctgtgcgacgacgcccccagtgacggctacgagtcgggacncgtacg

SEQ ID NO: 398367 - DNA, 586 bp, Homo sapiens
  misc_feature: GZ8MTXP02IYDI5.38.4.A04.1.454.CMB.2.raw
  modified_base (355)..(355): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccattcgccatctccagagacaacgccaagactcactgtggctgcacatgaacggcctgagaggcgacgacacggctgtgtacttctgtgcgagacgcccccatgagggctacngtggganctacgactttgactagtggggccagggaccctggtcaccgtctcctcacgcctcaccgaacgggcccagtccggtccttcccccgtcggcctaccccgtcctacccgaaacgcgccaccgtcgtcgggggacacgacgccgggcccgttgggcctcggcccgtcgggtaccgaacgggtaccttaacgttcccgaacggttcgacgtaccggacgttggacggg

SEQ ID NO: 398368 - DNA, 502 bp, Homo sapiens
  misc_feature: GZ8MTXP02IURTT.38.4.A04.1.454.CMB.2.raw
  modified_base (386)..(386): a, c, t, g, unknown or other
  modified_base (399)..(399): a, c, t, g, unknown or other
  modified_base (479)..(479): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagcctggtatcagcaaaaaaccagggaaagcccctaaacctcctgatctatggtgcatccatttgcaaagtgggtccatcaagtcagcggcagtgatctgggacagattcagtctcacaatcaagcagcctgcagcctggagatactnactattattattntactactatactaactactaccctactacttacgtcgacggacgtaagtacgtagatacaaacgaactacgtacgtctanaacgacactactctcttctactc

SEQ ID NO: 398369 - DNA, 536 bp, Homo sapiens
  misc_feature: GZ8MTXP02HXAUO.38.4.A04.1.454.CMB.2.raw
  modified_base (356)..(356): a, c, t, g, unknown or other
  modified_base (363)..(363): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaaggccgattcgccatctccagagacaacgccaagaactcactgtggctgcacatgaacggcctgagaggcgacgacacggctgtgtacttctgtgcgagagccccccatgaggctacngtggganctacgactttgaccttacgtgggggccagggaaccctggtcacgtctcctcacgcctcaccgaacgggcccatccggtcttccccctggccaccctcctccaagcgcacctcgtgggggcacgagcggccctgggctgcctggtcaggctaacttcacgtcgatcgactgcgg

SEQ ID NO: 398370 - DNA, 510 bp, Homo sapiens
  misc_feature: GZ8MTXP02GPHEN.38.4.A04.1.454.CMB.2.raw
  modified_base (500)..(500): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactatttaatgagctgggtccgccagcctccgagggaaggggctggagtgggtggccagcataaccagatggacgtgaaaaatctatgtggactctgtgaagggccattcgcatctcagagacaacgcaagactcactgtgctgcacatgaacgctgagaggcgacgacacggctgtgtacttctgtcgcgagacgcccccatgaagggctacgaggtgggacncgtacgtacg

SEQ ID NO: 398371 - DNA, 525 bp, Homo sapiens
  misc_feature: GZ8MTXP02I1NMY.38.4.A04.1.454.CMB.2.raw
  modified_base (284)..(284): a, c, t, g, unknown or other
  modified_base (296)..(296): a, c, t, g, unknown or other
  modified_base (471)..(471): a, c, t, g, unknown or other
  modified_base (504)..(504): a, c, t, g, unknown or other
  modified_base (515)..(515): a, c, t, g, unknown or other
tcagtcgatcacgtcacgaccggtgctcgatttagagtagtgatcaggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactatttaangagctgggtccnccagcctccagggagggctggagtgggttgccagcattaaccagatggaccgtagaaaaatctaatgtggactcgtgtgaaagggccgattcgccatctccagagacaacgccaaagactcaactgaggctgcacatgaacgcctagagaggcgacgacacggctgtgtacttcngtcgcgaagcgcccccaatcggaagggctacgnggtaggggacncgtacgtacg

SEQ ID NO: 398372 - DNA, 526 bp, Homo sapiens
  misc_feature: GZ8MTXP02F3JVL.38.4.A04.1.454.CMB.2.raw
  modified_base (296)..(296): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactattaatgagctgggtccnccagcctccgagggagggctggagtgggttgccagcataaccaagatggaccgtagaaaatactatgtaggactctgtgaagggcccgattcgccatctccagagacaacgcaagactcactgtgctgcacatgaacggcctaggacgaggcgacgacgacggctgtcgtacttcgtgtcgcgagaccgcccccagtcggaagggcctacgaggtggacgcgtacgtacg

SEQ ID NO: 398373 - DNA, 562 bp, Homo sapiens
  misc_feature: GZ8MTXP02F8A2P.38.4.A04.1.454.CMB.2.raw
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagacgcccccatggagggctacaggtggganctacgactttgactacgtggggccagggaaccctggtcaccgtctcctcacgcctccaccgaacgggcccatccggtccttcccccgtcggcccaccccgtccctccaaacgcgcaccgtcgcgggggcacgcgcggcccgtgggctcgcctggtacaaggacctaacttccgacgtgactcgactgacgg

SEQ ID NO: 398374 - DNA, 561 bp, Homo sapiens
  misc_feature: GZ8MTXP02IQNTY.38.4.A04.1.454.CMB.2.raw
  modified_base (269)..(269): a, c, t, g, unknown or other
  modified_base (292)..(292): a, c, t, g, unknown or other
  modified_base (402)..(402): a, c, t, g, unknown or other
  modified_base (427)..(427): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagcctggtatcagacaaaaacgagggaaacncccctaacctctgatctatggtncatcctattttgactaaaaggtcgggtacccagtacgaaaggttcaagcggcagtggatcgtgggacagtattcagtctacaacaatcagcagcctagcagccgtagganatactgactaattatattgtactanagtacttaaataccgttacccccagttacgtttggacccgtaaagggggtaacctaaaggtttcgggaaataaacgttaaccgaaaaagtactggtacggctacgaacaacctatctagtccttactacttccc

SEQ ID NO: 398375 - DNA, 533 bp, Homo sapiens
  misc_feature: GZ8MTXP02JK2CP.38.4.A04.1.454.CMB.2.raw
  modified_base (296)..(296): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactattaatgagctgggtccnccagcctccgagggaggggctggagtgggtggccagcattaaccaagatggaccgtagaaaaatctatgtggactcgtgtgaagggccattcgccatctccagagacacgccaaagacctcactgtgctgcacatgaacgctgagaggcgacggacacggctgtcgtacttcgtggtcgcgacgacgccccccgaagtcggaacgggctaacgaggtcgggggactccgtacgtacg

SEQ ID NO: 398376 - DNA, 562 bp, Homo sapiens
  misc_feature: GZ8MTXP02JYZY7.38.4.A04.1.454.CMB.2.raw
  modified_base (326)..(326): a, c, t, g, unknown or other
  modified_base (353)..(353): a, c, t, g, unknown or other
  modified_base (360)..(360): a, c, t, g, unknown or other
  modified_base (378)..(378): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctcagagacaacgccaagaactcactgtgctgcacatgaacgctgagaggcgacgacacggctgtgtacttcngtgcgagacgcccccatgaggctacgngtggganctacgactttgactacgnggggccagggaaccctggtcaccgtctcctcacgcctccaccgaacgggcccacgtccgggtcccttcccccgtcggcctacccctcctcccaagcgccaccctcgtcgggggccacgacgccggcccgtgggcctcgccgtcggtaccaacggactaaccgtccgacgtcgatcgactgacgg

SEQ ID NO: 398377 - DNA, 582 bp, Homo sapiens
  misc_feature: GZ8MTXP02FWVW4.38.4.A04.1.454.CMB.2.raw
  modified_base (373)..(373): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaaccaagatggacgtgaaaaatactatgtggactctgtgaagggccgattcgccatctccagagacaacgccaagaactcactgtggctgcacatgaacggctgagaggcgacgacacggctgtgtacttctgtgcgagacgccccccatggagggctacgaggtgggganccgtacgacttttggacctacgtggggccagggaaccctggtccaccgtctcctcagccctccacaacgggcccatccggtcccttcccccgtggcccacccctcctaccaacgacgccaccgtcgcgggggccacgacggccggccctggggcctcggacctcgggtaccaaggacctaacgttccgaaccgtgactcgactcgacgg

SEQ ID NO: 398378 - DNA, 540 bp, Homo sapiens
  misc_feature: GZ8MTXP02HQVY9.38.4.A04.1.454.CMB.2.raw
  modified_base (295)..(295): a, c, t, g, unknown or other
  modified_base (418)..(418): a, c, t, g, unknown or other
tcagtcgatcacgtcacgaccggtgctcgatttagagtagtgatcaggggtctcagagaggagccttagccctggactccaaggcctttccacttggtgatcagcactgagcacagaggactcaccatggaattggggctgagcgtggtttcctgttagctatttagaaggtgtccagtgtgaggtgcaactggtggagtctgggggaggcttggtccaggccggggggtccctgagactctcctgtgcagcctctgcattcacctttagtaactatttaatgagctgggtcccncagcctcgagggagggctggagtgggcgcagcaataaacagatggacgtagaaaatctatgtagactgtgtaggaagggccgtatcgcatctccagacgaacaacgaccaaagactcacgtgngctgcacagtagacggacgagagaggacgacgacgacgcgtgtcgtacttcgtgtcgcgacgaccgaccccgaccgtacggaacgggacgtacgtacggtacgggtacggtacgtacgtacg

SEQ ID NO: 398379 - DNA, 568 bp, Homo sapiens
  misc_feature: GZ8MTXP02HUJZR.38.4.A04.1.454.CMB.2.raw
  modified_base (366)..(366): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgccatctccagagacaacgcaagaactcactgtgctgcacatgaacggcctgagaggcgacgacacggctgtgtacttctgtgcgagacgccccccatgagggctacgagtgggganctacgactttgacttacgtgggggccaaggggaaccctggtccaccgtctccctcagccctccaccaacgggcccagtccggtccttccccctggccacccctcctcccaagacgccaccgtcgtcgggggcacgacgccggcccgtgggctcgccgtcggtacgaaggacctaaccgttcgacgttcgaatcgactgacgg

SEQ ID NO: 398380 - DNA, 529 bp, Homo sapiens
  misc_feature: GZ8MTXP02F5WQC.38.4.A04.1.454.CMB.2.raw
  modified_base (411)..(411): a, c, t, g, unknown or other
  modified_base (458)..(458): a, c, t, g, unknown or other
  modified_base (465)..(465): a, c, t, g, unknown or other
  modified_base (528)..(528): a, c, t, g, unknown or other
tcagtcgatcacgtcacgaccggtgctcgatttagagtagtgatcaggggaagaccgatgggcccttggggaggcttggtccagccgggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccattcgccatctccagagacaacgccaaagaactcactgtggctgcacatgaacggcctgagaggcgacgacacggctgtgtacttctgtgcgagacgcccccatgaggggctacgagtgggagctagactttgactactgggggccagggaaccctggtcaccgtctcctnagcctccacaagggcccatcggtctcccctggcaccctctccaagancactcgngggacacgacgcgccgtggctcgccgtcgacaaggactaacgtccgacgtcgactcgactcgng

SEQ ID NO: 398381 - DNA, 626 bp, Homo sapiens
  misc_feature: GZ8MTXP02I3FDV.38.4.A04.1.454.CMB.2.raw
  modified_base (299)..(299): a, c, t, g, unknown or other
  modified_base (321)..(321): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcgtgtaggctatttagaaggtgtccagtgtgaggtgcaactggtggagtcgtgggggaggcttggtccaggccggggggtccctgagactctcctgtgcagcctctgcattcacctttagtaactatttaatgagctggggtccccnccagcctacggaggggacgggngtggaggtgggcgccgagactaaacgtaaaccgaagtagtaggaaccgtaaagtaaaaactctagtggtacggtactcgtggtaggaacgggtccgtagttccgacctactcctacgaagacgaaccgaaaccgaccaaacgacctacacgtggtcgcgtacgacgacgacgtacgacggtaccgtaggacggacggacggacgacgacggtacgtacgtacgttacgttacgtgtcggacggacgaccgaccccgaccgtacggaacggtacgtacgtacggtacggtacggtacgtacgtacg

SEQ ID NO: 398382 - DNA, 579 bp, Homo sapiens
  misc_feature: GZ8MTXP02JK0FZ.38.4.A04.1.454.CMB.2.raw
  modified_base (360)..(360): a, c, t, g, unknown or other
  modified_base (367)..(367): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagaactcactgtgctgcacatgaacggcctgagaggcgacgacacggctggtgtacttctgtgcgagacgcccccatgagggctacgngtggganctacgactttgactagtgggggccagggaaccctggtcaccgtctcctcacgccctccaccgaacgggcccacgtccggtccttcccccgtcggcccacccctccctaccaacgacgccaccgtcgtcgggggccacgacggccggcccgtgggcctcggccgtcggtacgaacggacctaaccgttccgacgtcgacgtcgacgtggacgg

SEQ ID NO: 398383 - DNA, 557 bp, Homo sapiens
  misc_feature: GZ8MTXP02IRUPF.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtgggttttccttgttgctatttagaaggtgtccagtgtgaggtgcaactggtggagtcgtgggggaggcttggtccaggccgggggggtccctgagacctctcctgtgcagcctctgcattcacctttagtaactatttaatgagtcgtgggtcccgccacgccctccgaggggaggggctggaggtggggtcggcccagcattaaaccaagagtggaccgtagaaaaatactagtgtggactcgtgtgaagggccattcgcatctcagagacacgacaaagacctcactgtgctgcacatcgaaccggcgtagagcggacgacgacgacggctgtcgttacttcgtggtcgacggacgcccgacccccagtcggaacggctaacggacggtggacgtcgtaacgttaccg

SEQ ID NO: 398384 - DNA, 534 bp, Homo sapiens
  misc_feature: GZ8MTXP02IANP1.38.4.A04.1.454.CMB.2.raw
  modified_base (396)..(396): a, c, t, g, unknown or other
  modified_base (399)..(399): a, c, t, g, unknown or other
  modified_base (423)..(423): a, c, t, g, unknown or other
  modified_base (430)..(430): a, c, t, g, unknown or other
  modified_base (432)..(432): a, c, t, g, unknown or other
  modified_base (440)..(440): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagcgtggttttcctgttagctattttagaaggtgtccagtgtgaggtgcaactggtggagtctgggggaggcttggtccagccgggggggtcctgagactctcctgtgcagcctctgcattcacctttagtaactatttaatgagctggtccgcagcctccaggggaagggctggagtgggtgccagcagttaaccaaagatggacgtagaaaaatactaatgcggactctgtgaagggccgattcgcatcnccngagacaacgccaagaactcactgngctgcananagacgcgngagaggacgacgacgacgcgtgtcgtcttcgtcgtgacgacgaccgaccccgaccgtaacggacggacgtacgacggtacggacggtacgtacg

SEQ ID NO: 398385 - DNA, 527 bp, Homo sapiens
  misc_feature: GZ8MTXP02I3A4L.38.4.A04.1.454.CMB.2.raw
  modified_base (416)..(416): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagcctggtatcagacaaaaaccagggaaacgacccctaacctcctgatctatggtgcatccattttgacaaagtggggtccatcaaggtcagcggccagtggatcgtgggacaagattcaagtctacacaatcagcagacctgcacgcctagagatactagactaacttattattgtnttaccccagtacttaatacgttacccctactactttcgacctacgggactaagtacggagactacaaacaacgtgtacggctacgcactactactgtacttctactttccc

SEQ ID NO: 398386 - DNA, 565 bp, Homo sapiens
  misc_feature: GZ8MTXP02G1QJ6.38.4.A04.1.454.CMB.2.raw
  modified_base (331)..(331): a, c, t, g, unknown or other
  modified_base (367)..(367): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaaggggctggagtgggtggccagcattaaaccaagatggacgtagaaaaatactatgtggactctgtgaagggccattcgccatctcagagacaacgccaagactcactgtgctgcacatgaacgctgagaggcgacgacacggctgtgtacttcngtgcgagacgcccccagtgaggctacgaggtggganctacgatttgactacgtggggccagggaacctggcaccgtctcctcacgcctaccaccgaacgggcccagtccggtccttcccccgtcggccacccctcccaccaacgacgcctaccgtcgtgggggccacgacggccggcccgtgggcctagcccgtggaccaacggacctaacgtccacgtcgactcgactgacgg

SEQ ID NO: 398387 - DNA, 556 bp, Homo sapiens
  misc_feature: GZ8MTXP02FQT2F.38.4.A04.1.454.CMB.2.raw
  modified_base (306)..(306): a, c, t, g, unknown or other
  modified_base (367)..(367): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggtcagcattaaccaagatggacgtgaaaaatactatgtggactctgtgaagggccattcgccatctccagagacaacgccaagaactcactgtggctgcacatgaacggcctgagnggcgacgacacggctgtgtacttctgtgcgagacgccccccatgagggctacgagtggganctacgactttgactacgtgggggcccagggaaccctggtccacgtctcctcacgcctcaccacggcccatcggtcctccccgtcggccaccctcctccaacgacgcacctcgtgggggcacgacgccggcccgtcgggctcgccgtcggtacaacggtacctaacgtccacgtcgacgtcgactgacgg

SEQ ID NO: 398388 - DNA, 573 bp, Homo sapiens
  misc_feature: GZ8MTXP02IF62B.38.4.A04.1.454.CMB.2.raw
  modified_base (317)..(317): a, c, t, g, unknown or other
  modified_base (361)..(361): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactattttaatgagctgggtccgccagcctccagggaaggggctggagtgggtggccagcattaaccaagatggacgtgaaaaatctatgtggactctgtgaagggccattcgcatctccagagacaacgcaagaactcactgtggctgcacatgaacggcctgagaggcgacgacacggntgtgtacttctgtgcgagacgcccccatgaggctacagtggganctacgactttgactactgggggccagggaaccctggcaccgtctcctcagccctccaccgaacgggcccagtccggtccttccccctggccacccctcctcccaacgagccacctcgtgggggcacgacgccggcccgtggggctcggacccgtcgggtaccaaaggaccttaaccgttcccaacggttcgacttccggacgttcggacggg

SEQ ID NO: 398389 - DNA, 524 bp, Homo sapiens
  misc_feature: GZ8MTXP02GVQNS.38.4.A04.1.454.CMB.2.raw
  modified_base (297)..(297): a, c, t, g, unknown or other
  modified_base (402)..(402): a, c, t, g, unknown or other
  modified_base (513)..(513): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactatttaatgagctgggtccnccagcctccgagggaaggggctggagtgggtggccagcattaaaccaagatggaccgtagaaaaatctatgtggactctgtgaagggccattcgccatctcaganacaacgccaagactcactgtgctgcacatgaacgcctgagaggcgacgacacggctgtgtacttctgtcgcgacgacgcccccaagtcggaagggtctacgaggtgggacncgtacggtacg

SEQ ID NO: 398390 - DNA, 580 bp, Homo sapiens
  misc_feature: GZ8MTXP02GHBMF.38.4.A04.1.454.CMB.2.raw
  modified_base (373)..(373): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccaggggaaggggctggagtgggtggccagcattaaccaagatggacatagaaaaatactatgtggactctgtgaagggccgattcgccatctcagagacaacgccaagactcactgtggctgcacatgaacggcctgagaggcgacgacacggctgtgtacttcgtgtgcgagacgccccccccagtgagggctacgaggtggganctacgtctttgactacgtgggggccgacgggacccgtggtcaccgtctcactcagccctccaccgaacggcccactccggtccttcccccgtcggccaccctccctccaacgacgcaccgtcgtcgggggcacgacggccggcccgtcgggccgtcgccgtcggtaccgaacggtaccttaccgttcccgacgtcgacgtacggacg

SEQ ID NO: 398391 - DNA, 567 bp, Homo sapiens
  misc_feature: GZ8MTXP02H5F3K.38.4.A04.1.454.CMB.2.raw
  modified_base (295)..(295): a, c, t, g, unknown or other
  modified_base (545)..(545): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtcctgagactctcctgtgcagcctctgcattcaccttagtaactattaatgagctgggtccnccagcctcgagggagggctggagtgggtgcagcataaacagatggacgtagaaaaatctaatgtaggactctgtagaagggggcccaattccggcctagtccctaccgagaacgaaccaaacgacccaaaagtaacctcacgtgtcggctgacacatacgaacggcctaggagaggcgaacgacgacggctgtacgttacttcgtggtcgacggacgaccggcccccaagtcggaaggggtacctaacgngggtggacgtcctaacgtaccg

SEQ ID NO: 398392 - DNA, 597 bp, Homo sapiens
  misc_feature: GZ8MTXP02GZ1PU.38.4.A04.1.454.CMB.2.raw
  modified_base (366)..(366): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagactcactgtggctgcacatgaacggcctgagaggcgacgacacggctgtgtacttctgtgcgagacgcccccatgagggctacagtggganctagctttgactacgtgggggccagggaaccctggtcaccgtctcctcacgccctccacccgaacgggccccagtccggtccttccccccgtggcccacccctccctaccaacgacgaccacctcgtcgggggaccacgacggcccggcccgtggggcctcggacccgtgggtaccgaaacgggaccttaaccgttcccgaacggttcgaacgttccggacgttggacggg

SEQ ID NO: 398393 - DNA, 517 bp, Homo sapiens
  misc_feature: GZ8MTXP02I8YF5.38.4.A04.1.454.CMB.2.raw
  modified_base (285)..(285): a, c, t, g, unknown or other
  modified_base (297)..(297): a, c, t, g, unknown or other
  modified_base (429)..(429): a, c, t, g, unknown or other
  modified_base (457)..(457): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactattaangagctgggtccnccagcctccgagggaagggctggagtgggtggccagcattaaccaagatggaccgtagaaaaatctatgtggactcgtgtgaagggccattcgccatctccagagacaacgccaagactcactgtgctgcanatgaacgcctgagaggcgacgacacggntgtgtacttctgtcgcgacgacgcccccatggaagggctacgcgtgggacgctacgtacg

SEQ ID NO: 398394 - DNA, 581 bp, Homo sapiens
  misc_feature: GZ8MTXP02HAJJ9.38.4.A04.1.454.CMB.2.raw
  modified_base (367)..(367): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacgagtgggganctacgactttgactacgtggggccagggaaccctggtcaccgtctcctcacgccctaccacccgaacgggccccagtccggtccttcccccgtggcctaccccgtccctcccaaacgacgcacctcgtcgggggcacgacggccggcccgtgggcctcggcctcgggtaccaaggacctaacgttcccaacggttcgacgtccgacgtcgacgg

SEQ ID NO: 398395 - DNA, 544 bp, Homo sapiens
  misc_feature: GZ8MTXP02J019F.38.4.A04.1.454.CMB.2.raw
  modified_base (287)..(287): a, c, t, g, unknown or other
  modified_base (299)..(299): a, c, t, g, unknown or other
  modified_base (372)..(372): a, c, t, g, unknown or other
  modified_base (489)..(489): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggagcttggtccaggccgggggggtccctgagactctcctgtgcagcctctgcattcacctttagtaactatttaangagctgggtccncagcctccgagggagggctggagtggggtgccagcattaaaccagatggacgtagaaaatctaatgtggactntggtagaagggccattcgccatctccagacgacaacgccaaagaacctcactgtcggctgcacagtaggaaccggacctaggagacgggacgaccggacgacggctgtgtacttcgngtcgcgacgaccgcccccagtcggaaggcctacgacggtgggacacgtacgtacg

SEQ ID NO: 398396 - DNA, 560 bp, Homo sapiens
  misc_feature: GZ8MTXP02JDJA4.38.4.A04.1.454.CMB.2.raw
  modified_base (368)..(368): a, c, t, g, unknown or other
  modified_base (386)..(386): a, c, t, g, unknown or other
  modified_base (423)..(423): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaaccaagatggacgtgaaaaatactatgtggactctgtgaagggccgattcgccatctcagagacaacgccaagaactcactgtggctgcacatgaacggcctgagaggcgaacgacacggctgtgtacttctgtagcgagacgcccccatgaggctacagtgggganctacgactttgactacgnggggccaagggaaaccctggtacaccgtctcctcacnccaccacgaacgaccactcgtcctccctcgccaccctcctaccaacgacgacaccgtcgtcgggacgacgacgcggccgtcggcgtcgcgtcgtacgaacgacgtaacgtactacgtacgacgtacgacgtacgacg

SEQ ID NO: 398397 - DNA, 566 bp, Homo sapiens
  misc_feature: GZ8MTXP02HS182.38.4.A04.1.454.CMB.2.raw
  modified_base (361)..(361): a, c, t, g, unknown or other
  modified_base (368)..(368): a, c, t, g, unknown or other
  modified_base (416)..(416): a, c, t, g, unknown or other
  modified_base (461)..(461): a, c, t, g, unknown or other
  modified_base (492)..(492): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccgattcgccatctcagagacaacgcaagaactcactgtgctgcacatgaacggcctgagaggcgacgacacggctgtgtacttctgtgcgagacgcccccacgtgacggctacgnggtggancgtacgactttgactacgtgggggccaagggaccctggtccaccgtcncctcacgccctacacccgaacggcccacgtcggtcccttccccgngcctacccctcacccaaagcgtcaccgtcgnggggcacgcggcgcccgtgggcctgacccgtgaccaacggtactaaccgttcgacgtgaagttccgatcgacgg

SEQ ID NO: 398398 - DNA, 546 bp, Homo sapiens
  misc_feature: GZ8MTXP02HZM4E.38.4.A04.1.454.CMB.2.raw
  modified_base (298)..(298): a, c, t, g, unknown or other
  modified_base (457)..(457): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtgggttttccttgttgctatttagaaggtgtccagtgtgaggtgcaactggtggagtcgtgggggaggcttggtccaggccgggggggtccctggagactctcctgtgcagcctctgcattcaccttagtaactattaatgagctgggtccncagcctccgagggaggggctggagtggggtgccagcaataaaccaagatggaccgtagaaaaaatctatgtaggactctggtagaaaggggcccgaattccgctatctccaagacgacaacgaccaaagaactcaactgtgctgcacatgaacggccgngagaggcgaacgacgacggctgtgtactcgttgcgcgacgaccgccccctaagtcggaacggctacgacggtggacgacgttacgtacg

SEQ ID NO: 398399 - DNA, 520 bp, Homo sapiens
  misc_feature: GZ8MTXP02FJP2W.38.4.A04.1.454.CMB.2.raw
  modified_base (283)..(283): a, c, t, g, unknown or other
  modified_base (295)..(295): a, c, t, g, unknown or other
  modified_base (397)..(397): a, c, t, g, unknown or other
  modified_base (503)..(503): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggaggcttggtccaggccgggggggtccctgagactctcctgtgcagcctctgcattcacctttagaactattaangagctgggtccnccagcctccgaggggaaggggctggagtgggtggccagcataaccagatggacctagaaaaatctatgtggactctgtgaagggccattcgccatctcaganacaacgccaaagactcactgtgctgcacatcgaacggcctgagaggcgacgacacggctgtgtacttcgtgtcgcgacgaccgcccccaagtcggaagggctacgnggtggacgctacgtacg

SEQ ID NO: 398400 - DNA, 527 bp, Homo sapiens
  misc_feature: GZ8MTXP02FRJ6P.38.4.A04.1.454.CMB.2.raw
  modified_base (295)..(295): a, c, t, g, unknown or other
  modified_base (434)..(434): a, c, t, g, unknown or other
  modified_base (454)..(454): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcctgttagctattttagaaggtgtccagtgtgaggtgcaactggtggagtctgggggaggcttggtccaggccgggggggtccctgagactctcctgtgcagcctctgcattcacctttagaactattaatgagctgggtccnccagcctccgagggaaggggctggagtgggtggccagcattaaccaagatggaccgtagaaaaatctatgtggactgtgtgaagggccattcgcatctcagcgacaacgccaagactcatgtgctgcacatgacgaccngagaggacgacgacacgcgngtgtacttctgtgcgacgacgaccccgaccgcgaagggtcgtaccgacgtacgggaaggcgtacggttaaccg

SEQ ID NO: 398401 - DNA, 554 bp, Homo sapiens
  misc_feature: GZ8MTXP02HIR1Y.38.4.A04.1.454.CMB.2.raw
  modified_base (437)..(437): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctggagactctcctgtgcagcctctgcattcacctttagtaactatttaatgagctgggtccgccagcctccgaggggaaggggctggagtgggtggcagcataaccaagatggaccgtagaaaaatctatgtggactctgtgaaaggggccgattcgccatctccagacacaacgccaaagacctcaactgtgctgcanatgaacgcctagagacggacgacgacgacggctgtcgttacttcgtgtcgacggacgaccgcccccgtagtcgggaacgggtcctaacgagggtacgggactacgttaacgttacgg

SEQ ID NO: 398402 - DNA, 529 bp, Homo sapiens
  misc_feature: GZ8MTXP02IHQ7Q.38.4.A04.1.454.CMB.2.raw
  modified_base (298)..(298): a, c, t, g, unknown or other
  modified_base (420)..(420): a, c, t, g, unknown or other
  modified_base (425)..(425): a, c, t, g, unknown or other
  modified_base (474)..(474): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtgggggaggcttggtccaggccggggggtccctgagactctcctgtgcagcctctgcattcacctttagtaactatttaatgagctgggtcccnccagccctccgagggaggggctggagtgggtgccagcattaaccaagatggacctagaaaaatctatgtggactcgtgtgaaagggcccattcgccatctcagagacaacgcaaagaacctnactgngctgcacatgaacggctgagaggcgacgacgacggctgtcgtacttcgngtcgacgacgcgacccccagtacggaagggcctacgacggtggacgctacgtacg

SEQ ID NO: 398403 - DNA, 526 bp, Homo sapiens
  misc_feature: GZ8MTXP02HKHXF.38.4.A04.1.454.CMB.2.raw
  modified_base (292)..(292): a, c, t, g, unknown or other
  modified_base (301)..(301): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggcccgggggggtccctggagactctcctgtgcagcctctgcattcacctttagtaactattaatganctgggtccnccagcctccgagggaggctggagtgggtgccagcattaaaccaagatggaccgtagaaaaatctatgtggactcgtgtgaagggccgaattcgcctatctccagacgacaacgccaagaactcactgtggctgcacatgaacggcctagagaggcgacgacacggctgtgtactgtgtgcgagacgcccccatgaacgggctacgaggtggacgtcgtacgtacg

SEQ ID NO: 398404 - DNA, 608 bp, Homo sapiens
  misc_feature: GZ8MTXP02JSF87.38.4.A04.1.454.CMB.2.raw
  modified_base (460)..(460): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagaactcactgtggctgcacatgaacggcctgagaggcgacgacacggctgtgtacttctgtgcgagacgcccccagtggaggctacgaggtgggagctacgctttgactacgtgggggccagggaccctggtccaccgtctcctcacgccctccaccgaacgggccccagtccggtcccttcccccgnggcccacccctccctaccaacgacgccacccgtcggtcgggggccaccgacggcccgggcccgtggggccttcggccctttacgggaccgtaacgggtccttaaccgttcccgtaccgtcgtaccgtaccgtaccgtacggaccgggg

SEQ ID NO: 398405 - DNA, 540 bp, Homo sapiens
  misc_feature: GZ8MTXP02HI0DB.38.4.A04.1.454.CMB.2.raw
  modified_base (301)..(301): a, c, t, g, unknown or other
  modified_base (530)..(530): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggcccgggggggtccctggagactctcctgtgcagcctctgcattcacctttagtaactattaatgagctgggtccnccagcctccgagggaggggctggagtgggtgccagcattaaaccagatggaccgtagaaaaatctatgtggactcgtgtagaacgggccgattcgccatcctccagagacaacgccaaagactcactgtggctgccacatgaacggcctagagaggacgacgacgacgggctggtacgtacttctggtcgcgacgaccgcccccagtcggaaggctacgaggtgggacnctacggtacg

SEQ ID NO: 398406 - DNA, 510 bp, Homo sapiens
  misc_feature: GZ8MTXP02FQR5G.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagctggtatcagcaaaaacagggaaacgcccctaactcctgatctatggtgcatccattttgacaaagtggggtcccatcaagtcagcgcagtgatctgggacagattcagtctacacaatcagcagccctgcagcctggagatactgactaactttattattgtactacagtacttaaataccgttaccccatactttggcccgtaagggggaccaaggttcggagactacaaacgaactgtacgctagctacactctgtctacacttccc

SEQ ID NO: 398407 - DNA, 559 bp, Homo sapiens
  misc_feature: GZ8MTXP02HY65R.38.4.A04.1.454.CMB.2.raw
  modified_base (262)..(262): a, c, t, g, unknown or other
  modified_base (270)..(270): a, c, t, g, unknown or other
  modified_base (357)..(357): a, c, t, g, unknown or other
  modified_base (380)..(380): a, c, t, g, unknown or other
  modified_base (388)..(388): a, c, t, g, unknown or other
  modified_base (414)..(414): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagacaaaaaccngggaaacnccccctaaactcctgatctatggtgcatccattttgactaaaggtgggtcccatcaaagttcagcgcagtggatcgtggacagattnagtctcaacatcagcagcctgcngcctggantactgactaattattaattgtactanagtacttaaatacgttacccccatacgttttcggacccgtaaggggtacctaaaggttggaaagtactaacgaaaaccgtattaacgtcggaccttaggaaccctaacgtaacttccgttagtccctttacgtaactttcccccg

SEQ ID NO: 398408 - DNA, 557 bp, Homo sapiens
  misc_feature: GZ8MTXP02G5ZAQ.38.4.A04.1.454.CMB.2.raw
  modified_base (367)..(367): a, c, t, g, unknown or other
  modified_base (383)..(383): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaagaactcactgtgctgcacatgaacggcctgagaggcgacgacacggctgtgtacttctgtgcgagacgcccccagtgaggctagaggtggganctacgatttgactcgnggggccaggacctgcacgtctctcacgcctccaccgaacggcccagtccggtcccttcccccgtcggccctacccctcctaccaacgcgccaccgtcgtcggggcacgacgccggcccgtgggctcgccgtcggtaccaacggactaaccgtccgacgtgactcgacgtgacgg

SEQ ID NO: 398409 - DNA, 522 bp, Homo sapiens
  misc_feature: GZ8MTXP02GMUOM.38.4.A04.1.454.CMB.2.raw
  modified_base (418)..(418): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcctgtagctatttagaaggtgtccagtgtgaggtgcaactggtggagtctgggggagcttggtccaggccgggggggtccctgagactctcctgtgcagcctctgcattcacctttagtaactatttaatgagctgggtccgccagcctccgagggaggggctggagtggggtgccagcattaaccagatggaccgtagaaaatctatgtggactctgtgaagggccattcgccatctccagagacaacgccaaagaactcactgngctgcacatgaacgcctgagaggcgacgacgacggctgtgtacttctggtcgcgacgacgcccccatggaacgggtctacgaggtgggacgtcgtaacgttacg

SEQ ID NO: 398410 - DNA, 533 bp, Homo sapiens
  misc_feature: GZ8MTXP02I857S.38.4.A04.1.454.CMB.2.raw
  modified_base (429)..(429): a, c, t, g, unknown or other
  modified_base (448)..(448): a, c, t, g, unknown or other
  modified_base (477)..(477): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttgggtccaggcccgggggggtccctgagactctcctgtgcagcctctgcattcacctttagtaactatttaaatgagctggggtcccgccagcctccgaggggaaggggctggagtgggtgccagcattaaccaagatggacgtagaaaaatctatgtgactctgtgagggccgattcgccatctccagagacaacgacaagaactcactgnggctgcacatcgacggccngagaggcgacgacacggctgtcgtacttntcggtacgcgacgccgcccccagtggaacgggctacgaggtcgggaacgctaacgg

SEQ ID NO: 398411 - DNA, 542 bp, Homo sapiens
  misc_feature: GZ8MTXP02FGIWZ.38.4.A04.1.454.CMB.2.raw
  modified_base (258)..(258): a, c, t, g, unknown or other
  modified_base (296)..(296): a, c, t, g, unknown or other
  modified_base (371)..(371): a, c, t, g, unknown or other
  modified_base (428)..(428): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctggtttcctgttgctattttagaaggtgtccagtgtgaggtgcaacgtggtggagtcgtgggggaggcttggtccaggccgggggggtccctgagactctcctgtgcagcctngctattcacctttagtaactattaatgagctgggtccncagcctccgagggagggctggagtgggtgccagcaataaccaagataggaccgtagaaaaatctatgtggactcngtgaaagggccgattcgcatctcagagacaacgacaagactcactgtgctgccaaanagacgacgcgagacgacggacgaacgacgacggcgtgtacgtacttcgtgtcgacgaacgacccgaccccgagtacggaacggactacggacggtacggacgtacgtacgtacg

SEQ ID NO: 398412 - DNA, 617 bp, Homo sapiens
  misc_feature: GZ8MTXP02G8WEF.38.4.A04.1.454.CMB.2.raw
  modified_base (303)..(303): a, c, t, g, unknown or other
  modified_base (364)..(364): a, c, t, g, unknown or other
  modified_base (385)..(385): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccattcgccatctccagagacaacgcaagactcactgtggctgcacatgaacgctgagnggcgacgacacggctgtgtacttctgtgcgagacgcccccagtgaggctacgaggtggganctacgtactttgaccttaggngggggcccaggggaaccctggtccaccgtctcctcacgccctcccgaccgaacgggcccctacgtccgggttccctttcccccgtcggccctaccccttccctaccaacggacgccgacccgtcggtcgggggccacgacggccggcccgtcggggcctcggcccgtcgggtacgaaacgggtaccttaaccgttacccaacggttcgaacgtccggaaccgtggaaccggg

SEQ ID NO: 398413 - DNA, 561 bp, Homo sapiens
  misc_feature: GZ8MTXP02F7QIH.38.4.A04.1.454.CMB.2.raw
  modified_base (332)..(332): a, c, t, g, unknown or other
  modified_base (367)..(367): a, c, t, g, unknown or other
  modified_base (386)..(386): a, c, t, g, unknown or other
  modified_base (458)..(458): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcaccttttagtaactatttaatgagctgggtccgccagcctccagggaaggggctggagtgggtggccagcattaaaccaagatggacgtgaaaaatctatgtggactctgtgaagggccgattcgccatctccagagacaacgccaaagaactcactgtgctgcacatgaacggctgagaggcgacgacacggctgtgtacttcnggtgcgagacgcccccatgaggctacgagtggganctaacgctttgacttacgngggggcccaagggaacccctggtccaccgtctcctcacgccctcaaccacgggcccatcggtccttcccccnggccacccctcctccaaacgcgacaccgttcgcgggggcacgacgccggccctggggcctcgcctcggtacaaggactaactccgacgtcgatcgactgacgg

SEQ ID NO: 398414 - DNA, 588 bp, Homo sapiens
  misc_feature: GZ8MTXP02JHUFV.38.4.A04.1.454.CMB.2.raw
  modified_base (365)..(365): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaaggccgattcgccatctccagagacaacgccaagaactcactgtggctgcacatgaacggcctgagaggcacgacacggctgtgtacttctgtgcgagacgcccccatgaggctacgaggtggganctacgactttgactacgtgggggccagggaaccctggtcaccgtctctcacgcctcccaccaacgggcccactccggtcccttccccgtcggccacccctccctcccaaacgacgaccaccgtccgtcgggggcacgacggccggcccgtcggggccgtcggccgttcgggtaccgaacggacctaaccttcccgaacgttcggaattccggacctaggcggg

SEQ ID NO: 398415 - DNA, 615 bp, Homo sapiens
  misc_feature: GZ8MTXP02F0MKX.38.4.A04.1.454.CMB.2.raw
  modified_base (310)..(310): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgaggggaaggggctggagtgggtggccagcattaaaccaagatggacgtagaaaaatctatgtggactctgtgaagggccgattcgccatctccagagacaacgccaaagactcactgtggctgcacatgaacggcctgagnggcgacgacacggctgtgtacttcgtgtgcgagacgcccccagtgagggctacgaggtggggatcgtacgtactttgaccttacggtcgggggaccagggaacccgtggtccacccgtctcctcacgccctaccgaacccgaacgggcccacgttccggtcccttcccccgtcggcccacccctcctacccgaaacgcgccaccgtcggtcgggggccacgacggcccggcccgtcgggcctcgaccgtcggtaccgaacggtaccttaaccgttcccgaacggtcgacgtcggacgtggacggg

SEQ ID NO: 398416 - DNA, 593 bp, Homo sapiens
  misc_feature: GZ8MTXP02GWQGQ.38.4.A04.1.454.CMB.2.raw
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaaggccattcgccatctcagagacaacgccaagaactcactgtggctgcacatgaacggcctggagaggcgaacgacacggctgtgtacttctgtgcgagacgcccccatggagggctacgaggtgggatcctacgtactttgactacgtggggccaggggaaccctggtccaccgtctccctcacgccctccaaccgaacgggcccacgtccggtcccttcccccgtggcccacccctccgtaccaaacgacgcctaacccgtcgtcgggggaccacgacgcccggcccgtgggcctcggcccgtggtaccgaaggtacctaacgttcccgacgttcgacgtcgaccgtgacggg

SEQ ID NO: 398417 - DNA, 546 bp, Homo sapiens
  misc_feature: GZ8MTXP02FJ48I.38.4.A04.1.454.CMB.2.raw
  modified_base (159)..(159): a, c, t, g, unknown or other
  modified_base (303)..(303): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccnccagcctccagggaagggctggagtgggtggccagcattaaccaagatggacgtgaaaaatctatgtggactctgtgaagggccgattcgccatctccagagacaacgccaagactcactgtggctgcacatgaacggctgagnggcacgacacggctgtgtacttctgtgcgagacgcccccagtgagggctacagtggganctacgactttgactacgtgggggcccagggaaccctggtcaccgtctcctcagcctccaccaagggcccatccggtccttcccccgtggccacccctcctaccaacgacgcacctcgcgggggcacgcgccggcccgtgggctcgcctggtccaaggactaacgttccacgtgatacgcgtgcg

SEQ ID NO: 398418 - DNA, 563 bp, Homo sapiens
  misc_feature: GZ8MTXP02IOMBR.38.4.A04.1.454.CMB.2.raw
  modified_base (357)..(357): a, c, t, g, unknown or other
  modified_base (365)..(365): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgccaagactcactgtggctgcacatgaacggcctgagaggcgacgacacggctgtgtacttctgtgcgagacgcccccatgagggctacngtggggancgtacgctttggacttacgtgggggccagggaaccctggtccaccgtctcctcagccctcacccaacgggcccagtccggtcccttcccccgtggcccacccctcctacccaaacgcgcacctcgtcgggggcacgagccggtccctgggcctgccgtggtacaaggactaacgttccacgtcgatcggactggacgg

SEQ ID NO: 398419 - DNA, 631 bp, Homo sapiens
  misc_feature: GZ8MTXP02G1ANB.38.4.A04.1.454.CMB.2.raw
  modified_base (331)..(331): a, c, t, g, unknown or other
  modified_base (365)..(365): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgaggggaaggggctgggagtgggtggccagcattaaccaagatggacgtagaaaaaatactatgtggactctgtgaagggccattcgccatctcagagacaacgcaagactcactgtgctgcacatgaacggctgagaggcgacgacacggctgtgtacttcngtgcgagacgcccccatgaggctacgaggtgganctacgactttgactacgtgggggccaagggaaccctggtccaccgtctccctcacgccctacccgaacccgaacggggccccagtcccggttcccttcccccgtcggcccaccccttcccacccaaacgacgccaacccccgtgggggccaaccgacggcccgggtccccgtcgggggcctcggcccgttcgggtaccgaaaacgggtacccttaaccgttcccgaacggttacggaactccggaaccgtcggaacggcccggggg

SEQ ID NO: 398420 - DNA, 586 bp, Homo sapiens
  misc_feature: GZ8MTXP02GOR4M.38.4.A04.1.454.CMB.2.raw
  modified_base (369)..(369): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcaccttttagtaactatttaatgagctgggtccgccagcctccgagggaaggggctggagtgggtggccagcattaaccaagatggacgtagaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacaggtggganctacgactttgactacgtgggggccagggaaccctggtcaccgtctcctcacgccctccaccgaacgggcccacgtccggtccttcccccgtcggcccacccctccctacccaacgacgccaccctcgtcgggggccacgacgccggcccgtgggctcggccgtcgggtaccaacgggaccttaacgttcccgacgttcggactcggactggacggg

SEQ ID NO: 398421 - DNA, 560 bp, Homo sapiens
  misc_feature: GZ8MTXP02INL87.38.4.A04.1.454.CMB.2.raw
  modified_base (356)..(356): a, c, t, g, unknown or other
  modified_base (363)..(363): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaaggccgattcgccatctcagagacaacgccaagaactcactgtgctgcacatgaacggcctgagaggcgacgacacggctgtgtacttctgtgcgagacgcccccatgaggctacnggtgganctacgactttgactacgtggggccagggaccctggcaccgtctcctcacgcctccaccaacgggcccatccggtccttcccccgtggcccacccctcctacccgaagacgccaccgtcgtgggggccacgacgccggccccgtggggcctggcctcggtacaacggaccttaacttccacgtgactcggactgacgg

SEQ ID NO: 398422 - DNA, 527 bp, Homo sapiens
  misc_feature: GZ8MTXP02GFMTB.38.4.A04.1.454.CMB.2.raw
  modified_base (298)..(298): a, c, t, g, unknown or other
  modified_base (476)..(476): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctggagactctcctgtgcagcctctgcattcacctttagtaactattaatgagctgggtccnccagccctccgaggggaaggggctggagtgggtggccagcataaaccagatggaccgtagaaaaatctatgtggactcgtgtggaaaggggcccattcgaccatcctccagagacaacgccaaagactcactgtgctgcacatgacgctgagaggcgacgacacggctgtgtacttcngtgcgagaccgcccccatcggaacgggctacgaggtggacgtctacgtacg

SEQ ID NO: 398423 - DNA, 554 bp, Homo sapiens
  misc_feature: GZ8MTXP02HVMZ6.38.4.A04.1.454.CMB.2.raw
  modified_base (379)..(379): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcagttaggacttcgtttagcctggtatcagacaaaaaccgagggaaacgccccctaaacctcctagactctagtggtgcattccattttgactaaaggtggggtacccatcaaaggtttcaggcggcagtgatcgtgggacagattcagtctcaanaatcaagcagcctagcagccgtggagtatactgactaaactttattattgtacttacagtacttaactacgttaccccctatacgtttcgaccgtaaggggacctaaggttcggaagtactaacgaaaacgtactggtacgctacgaactaccattcagtttctactacttcccg

SEQ ID NO: 398424 - DNA, 603 bp, Homo sapiens
  misc_feature: GZ8MTXP02JPYWZ.38.4.A04.1.454.CMB.2.raw
  modified_base (331)..(331): a, c, t, g, unknown or other
  modified_base (360)..(360): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaaggccgattcgccatctcagagacaacgccaagaactcactgtggctgcacatgaacggcctgagaggcacgacacggctggtgtacttcngtgcgagacgcccccagtgagggctacgnggtggganctacgactttgactacgtgggggccagggaccctggtcaccgtctcctcacgccctccaccgacgggcccacgtccggtcccttcccccgtcggccctacccctccctaccgaacgcgccaccgtcggtcgggggccacgacggcccgggcccgtcgggccgtcggcccgttcgggtaccgaacgggtaccttaaccgttcccgtacggtcgtacgtccggacgtcggaccgggg

SEQ ID NO: 398425 - DNA, 595 bp, Homo sapiens
  misc_feature: GZ8MTXP02GDROD.38.4.A04.1.454.CMB.2.raw
  modified_base (288)..(288): a, c, t, g, unknown or other
  modified_base (335)..(335): a, c, t, g, unknown or other
  modified_base (374)..(374): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcacctttagtaactatttaatgagctgggtccgccagcctccagggaaggggctggagtgggtggccagcattaaaccaagatggacgtagaaaaaatactatgtggactctgtgaagggccgattcgccatctcagagacaacgccaagaactcactgngctgcacatgaacggcctagagaggcgacgacacggctgtgtacttntgtgcgagacgcccccagtgagggctaacgagtgggganctaacgactttggaactacggtggggccaagggaaccctggccaccgtctcctcagccctaccaaccgaacgggcccagtccggtcccttccccgtcggccctaccctccctacccaaacgacgcctaaccgtcggcgggggacacgacggccggtcccgtggggccttcggccgtcggtacaacggacctaacgttcccgagtcgatacggactgacggg

SEQ ID NO: 398426 - DNA, 544 bp, Homo sapiens
  misc_feature: GZ8MTXP02JM05K.38.4.A04.1.454.CMB.2.raw
  modified_base (449)..(449): a, c, t, g, unknown or other
  modified_base (515)..(515): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaacttattaatgagctggggtccgccagcctccgaggggaaggggctggagtgggtggccagcattaaccaagatggaccgtgaaaaatctatgtggactctgtgaaagggccgattcgccatctccagagacaacgccaagactcaactgtgctgcacatgaacggctgagnggacgacgacacggctgtgtacttcgtgtcgcggacgacgccccccgatcggaacgggcctaacgnggttacggggacgtaccgtacgtttaccg

SEQ ID NO: 398427 - DNA, 513 bp, Homo sapiens
  misc_feature: GZ8MTXP02GC0MM.38.4.A04.1.454.CMB.2.raw
  modified_base (391)..(391): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttgggtccaggccggggggtccctgagactctcctgtgcagcctctgcattcaccttagtaactatttaatgagctgggtccgccagcctcgagggaagggctggagtggggtggccagcattaaccagatggacctagaaaatctatgtggactcgtgtgaaggccattcgcatcncagagacacgcaagactcactgtgctgcacagtgacgccgtagacgaggcgacgacacggctgtgtactcgtgcgcgacgacgcccccagtcggaacggctacgcggtggactcgtacgtcg

SEQ ID NO: 398428 - DNA, 538 bp, Homo sapiens
  misc_feature: GZ8MTXP02JFU84.38.4.A04.1.454.CMB.2.raw
  modified_base (297)..(297): a, c, t, g, unknown or other
  modified_base (528)..(528): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtctgggggaggcttggtccaggccgggggggtccctggagactctcctgtgcagcctctgcattcacctttagtaactattaatgagctgggtccnccagcctcgagggaagggctggagtgggtgccagcattaaccagatggaccgtagaaaaatctatgtggactcgtgtaggaaaggggccaattccgccatcctccaagacgacaacgccaaagaacctcaactgtggctgcaacatgaacggcctaggagaggcgacgacacggctgtcgtacttctgtcgcgagaccgcccccagtcggaacgggctacgaggtgggacncgtacgtacg

SEQ ID NO: 398429 - DNA, 572 bp, Homo sapiens
  misc_feature: GZ8MTXP02HYAB1.38.4.A04.1.454.CMB.2.raw
  modified_base (352)..(352): a, c, t, g, unknown or other
  modified_base (360)..(360): a, c, t, g, unknown or other
tcagtcgatcacgtcacgaccggtgctcgatttagagtagtgatcaggggaagaccgatgggcccttggggaggcttggtccagccgggggtccctgagactctcctgtgcagcctctgcattcacctttagtaactatttaatgagctgggtccgccagcctccagggaagggctggagtgggtggccagcattaaccaagatggacgtgaaaaatactatgtggactctgtgaagggccgattcgccatctcagagacaacgccaagaactcactgtggctgcacatgaacggctgagaggcgacgacacggctgtgtacttctgtgcgagagcccccatgagggctacngtgggganctacgactttgactactggggccagggaccctggtcaccgtctcctcacgccctcaccgaacgggcccatccggttccttccccctcggccacccctcctacccgaacgacgccacccgtcgtcgggggcacgacgccggcccgtggggcctggcctcgggtccaacgggacctaacgtttcccaacggttcgacgttccgacgtaggacgg

SEQ ID NO: 398430 - DNA, 557 bp, Homo sapiens
  misc_feature: GZ8MTXP02FOJ1A.38.4.A04.1.454.CMB.2.raw
  modified_base (363)..(363): a, c, t, g, unknown or other
  modified_base (480)..(480): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctcagagacaacgcaagactcactgtggctgcacatgaacggcctgagaggcgacgacacggctgtgtacttctgtgcgagacgcccccatgaggctacaggtggganctacgactttgactacgtggggccagggaaccctggtccacccgtctcctcacgccctaccaccgaagggcccagtccgggtcccttcccccgtggccctaccctcctaccaacgcnccacctcggtgggggcacgacgccggccgtgggctgcctcggtcaacggctaacttcgaacgtcgatcgactgacgg

SEQ ID NO: 398431 - DNA, 533 bp, Homo sapiens
  misc_feature: GZ8MTXP02IKPT9.38.4.A04.1.454.CMB.2.raw
  modified_base (296)..(296): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttccttgttgctatttagaggtgtccagtgtgaggtgcaactggtggagtcgtgggggagcttggtccgaggccggggggtccctggagactctcctgtgcagcctctgcattcacctttagtaactatttaatgagctgggtccnccagcctccgagggaaggggctggagtgggtggccagcattaaaccaagatggaccgtagaaaaatctatgtaggactcgtgtaggaagggccgtattcgaccatcctccagagacaacgaccaaagactcactgtgctgcacatgaacgctagaggagcgacgacacggctgtcgtacttctgtgcgacgacgcccccagtggaacgggctaacgaggtgggacgtctacgttacg

SEQ ID NO: 398432 - DNA, 527 bp, Homo sapiens
  misc_feature: GZ8MTXP02G2UP4.38.4.A04.1.454.CMB.2.raw
  modified_base (390)..(390): a, c, t, g, unknown or other
  modified_base (408)..(408): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactcgttagcctggtatcagacaaaaaccagggaaacgcccctaactcctgatctatggtgcatccattttgactaaaggtggggtcccatcaaggttcagtcggcagtgatcgtgggacagattcagtctacacaatcagcagcctgcagcctaggganatactgactaacttattnttgtacttacagtacttaaatcgttacccccatactttggacctaggggacctaaggttcggagtatacgaaacgtactgtacggactgctacgacttctacgtcttacgactttcccg

SEQ ID NO: 398433 - DNA, 518 bp, Homo sapiens
  misc_feature: GZ8MTXP02FJUSK.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactattaatgagctgggtccgccagcctccgagggaaggggctggagtgggtggccagcattaaaccagatggaccgtagaaaaatactatgtggactctgtgaagggccgattcgcatctcagagacaacgcaagactcactgtgctgcacatgaacggcctgagaggcgacgacacggctgtgtacttctgtcgcgagacgcccccagtgaaggctacgacggtgggacgcgtacgtacg

SEQ ID NO: 398434 - DNA, 542 bp, Homo sapiens
  misc_feature: GZ8MTXP02FFTLO.38.4.A04.1.454.CMB.2.raw
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtactctgtgcgagacgcccccatgagggctacagtgggagctacgactttgactatgggggccagggaaccctggtcaccgtctcctcacgcctccaccaagggcccatccggtcttccccctggccaccctccctccaacgacgcaccctctgggggcacgagccggccctggggctcggcctgggtcaaggactaacttccacgtgatcgactgagg

SEQ ID NO: 398435 - DNA, 596 bp, Homo sapiens
  misc_feature: GZ8MTXP02F3A7F.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacgctgagaggcgacgacacggctgtgtacttctgtgcgagacgcccccagtgagggctacgaggtgggagctacgactttgaccgtaccggggcacggggaaccctgggtcacccgtctcctcacgccctccaccgaacgggccccagtccggtccttccccccgtggcccaccccctcctacccgaaagcgcctacccgtcgtcgggggccacgacggcccggtccctcggggctcggccgtcgggtaccgaaaacggtcctaaccgttccgacgtggactcgactggcggccggg

SEQ ID NO: 398436 - DNA, 540 bp, Homo sapiens
  misc_feature: GZ8MTXP02INNB6.38.4.A04.1.454.CMB.2.raw
  modified_base (262)..(262): a, c, t, g, unknown or other
  modified_base (409)..(409): a, c, t, g, unknown or other
  modified_base (439)..(439): a, c, t, g, unknown or other
  modified_base (534)..(534): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggcccgggggggtccctgagactctcctgtgcagcctntgcattcacctttagtaactatttaatgagctgggtcccgccagcctccgaggggaaggggctggagtggggtgccagcaattaaccaaagatggaacgtagaaaaaatctaatgtggacttctgtggaacggccgattcgccatcnccagagacaaacgcaaagtaactcaactgngctgcacatgaacggcctgagaggcgaacgactacgggctgtagtacttctggtcgcgagaccgcccccaagtgacgggctacgaggtcgggacnctaacg

SEQ ID NO: 398437 - DNA, 559 bp, Homo sapiens
  misc_feature: GZ8MTXP02GT8GE.38.4.A04.1.454.CMB.2.raw
  modified_base (331)..(331): a, c, t, g, unknown or other
  modified_base (359)..(359): a, c, t, g, unknown or other
  modified_base (365)..(365): a, c, t, g, unknown or other
  modified_base (382)..(382): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagactcactgtggctgcacatgaacggcctgagaggcgacgacacggctggtgtactttcngtgcgagacgcccccatgagggctacgngtgganctacgctttgactacgnggggccagggaaccctggtcaccgtctcctcagccctccaccaagggccccagtccggtcccttcccccgtggccaccccgtcctaccaacgacgccacctcgtaggggccacgacgccggccgtgggcctggcctggtcaaggacctaacgttccacgttcgatccgacgtgacgg

SEQ ID NO: 398438 - DNA, 528 bp, Homo sapiens
  misc_feature: GZ8MTXP02JD055.38.4.A04.1.454.CMB.2.raw
  modified_base (470)..(470): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcaccttagtaactattaatgagctgggtccgccagcctccagggaaggggctggagtgggtggccagcataaccaagatggaccgtagaaaatactatgtggactctgtaggaaggggccagttcgccatctccaagacgaacaacgacccaaagaacctcactagtgctgcacatgaacgcctagagaggcgacgacacggctgngtactctggtcgcgagacgcccccatggaaggctacgaggtgggacgtcgtacgtacg

SEQ ID NO: 398439 - DNA, 546 bp, Homo sapiens
  misc_feature: GZ8MTXP02J22V9.38.4.A04.1.454.CMB.2.raw
  modified_base (295)..(295): a, c, t, g, unknown or other
  modified_base (368)..(368): a, c, t, g, unknown or other
tcagtcgatcacgtcacgaccggtgctcgatttagagtagtgatcagggggagtcagtcccagtcaggacacagcatggacatgagggtccccgctcagctcccggggctcctgctgctctggctcccaggtgccggatgtgacatccagttggcccagtctccatccttcctgtctgcatctggtagggacagagtcaccatcacgttgccggcagtcagggcagttaggacttcgtttagcctggtatcagacaaaaaccgaggaaacgcccctaacctcctgatctatggtnctatcctatttgactaaaggtcgggtaccatcaaggttcagcggcaggtgatcgtggacagaatcagtctcanatcgagcagccctgacagccgtagacgtactacgtcgactaacgtttattacgttgtactaacagttacttaacttaccgttaccccacttacgtttcggacgtaggggaacctaaggtgaacgtatacgaaacgtactgtacgctacgacaacctatcgtactctcactcgttaccc

SEQ ID NO: 398440 - DNA, 599 bp, Homo sapiens
  misc_feature: GZ8MTXP02IETT2.38.4.A04.1.454.CMB.2.raw
  modified_base (291)..(291): a, c, t, g, unknown or other
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccgagggcccgggggggtcctggagactctcctgtgcagcctctgcattcacctttagtaactatttaangagctgggtccnccagcctcgagggaggctggagtgggtgcagcattaaaccagatggaccgtagaaaaatctatgtaggactctaggtagaacggggcccgtagttcccggcctatcccttacccaagaacgaaccaaaccgacccaaagaaacctcaacgtgtcggctgccacgattacggaaaccggtcccgtaggaggaacgggaccgaacggacgacgggctggtcgttacgttccgttggtcgcggacgacccgcccccgacgtcggaacggtcacgtaggtgggacgtacgtacgttaccg

SEQ ID NO: 398441 - DNA, 590 bp, Homo sapiens
  misc_feature: GZ8MTXP02JH1XP.38.4.A04.1.454.CMB.2.raw
  modified_base (290)..(290): a, c, t, g, unknown or other
  modified_base (321)..(321): a, c, t, g, unknown or other
  modified_base (329)..(329): a, c, t, g, unknown or other
  modified_base (346)..(346): a, c, t, g, unknown or other
  modified_base (588)..(589): a, c, t, g, unknown or other
tcagtcgatcacgtcacgaccggtgctcgatttagagtagtgatcaggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaagaactcactgtggctgcacatgaacggctgagaggcgacgacacggctgtgtacttcngtgcgagacgcccccagtggacgggctacgnggtggganctacgatttgacctagnggggccagggaccctggtcaccgtctcctcacgccctccgaaccgacgggccctacgtcccgtcccttcccccgtcggcccacccctccctaccaagacgccaccgtcgtcgggggccacgacggccggcccgtgggcctcggccgtaggtaccaagggtaccttaccgtaccgtacgtacgacgttaccgaacgttggacggccggggtacgtcgggaacgaaacggccggacagtcggcnng

SEQ ID NO: 398442 - DNA, 618 bp, Homo sapiens
  misc_feature: GZ8MTXP02GT2EC.38.4.A04.1.454.CMB.2.raw
  modified_base (335)..(335): a, c, t, g, unknown or other
  modified_base (373)..(373): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaaagactcactgtggctgcacatgaacggtctggagaggcgacgacacggctggtgtacttcngtgcgagacgcccccagtggagggctacgaggtgggancgtacgtactttgactacgtgggggaccacgggaacccgtggtccacccgtcgtccctcgacgtccctacccaccgaacgggccctacgtccggtcccttcccccgtcggcccacccctccctaccaacgcgccaccgtcgtcgggggccacgacggccggcccgtcgggcctcggtccgtcgggtaccgtaacgggtacctaaccgttccgaaccggttcgacgtaccggtacgtacggacggg

SEQ ID NO: 398443 - DNA, 577 bp, Homo sapiens
  misc_feature: GZ8MTXP02HGRB9.38.4.A04.1.454.CMB.2.raw
  modified_base (367)..(367): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaaccaagatggacgtagaaaaatactatgtggactctgtgaaggccgattcgcatctccagagacaacgcaagaactcactgtgctgcacatgaacggcctgagaggcgacgacacggctgtgtacttctgtgcgagacgcccccatggacggctacgaggtggganctacgatttgactacgtggggccaggacctgtcaccgtctcctcacgcctccacgaacggcccacgtccggtcccttcccccgtcggcctacccctccctaccaacgacgccaccgtcgtcggggaccacgacggccggcccgtcgggcctcggccgtcggtaccgaacggtacctaaccgttccgacgttcgacgtcgacgtcgacggg

SEQ ID NO: 398444 - DNA, 531 bp, Homo sapiens
  misc_feature: GZ8MTXP02JQ5WK.38.4.A04.1.454.CMB.2.raw
  modified_base (297)..(297): a, c, t, g, unknown or other
  modified_base (327)..(327): a, c, t, g, unknown or other
  modified_base (416)..(416): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactattaatgagctgggtccncagcctccgagggagggctggagtgggttnccagcattaaaccagatggaccgtgaaaaatctaatgtggactctgtgaacgggccgattcgccatctccagagacaacgccaaagacncactgagctgcacatgaacgtctgagaggcgacgacacggctgtcgtacttctgtcgcgaacgcgaccccccaatcggaacggggctaacgaggtcgggacgtaccgtacgtacg

SEQ ID NO: 398445 - DNA, 570 bp, Homo sapiens
  misc_feature: GZ8MTXP02FQ1G6.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactcgtttagcctggtatcagacaaaaaccgagggaaacgcccctaactcctagatctatggtgcatcctatttgactaaaggtcgggtcccatcaagtcagcggcagtgatcgtgggacagtattcagttctacacaatcagcacgcctgcagcctaggatatacgtgactaaatttattattgtactaacgattactttaaatacccgttaacccccagttacgttttacgggacccgtaaagggggtacctaaaaggttacgggaacgtaacttaaccgaaaacgtaacgtgtacggctagaacctaacctattactgttaccttacactttccccg

SEQ ID NO: 398446 - DNA, 584 bp, Homo sapiens
  misc_feature: GZ8MTXP02F3B72.38.4.A04.1.454.CMB.2.raw
  modified_base (367)..(367): a, c, t, g, unknown or other
  modified_base (475)..(475): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgcccaagaactcactgtggctgcacatgaacggcctgagaggcacgacacggctgtgtacttctggtgcgagacgcccccatgagggctacgagtggganctacgctttgacctagtggggaccagggaccctggtccaccgtctcctcacgccctaccgaccgaacgggcccagtccggtcccttccccctcggccaccccttaccnccaaacgcaccaccgtcgtgggggccacgacgtccggccctcgggccttcgccgtcggtaccgaacggtacctaacgttacccgacgttacgacgtcgacctggacggg

SEQ ID NO: 398447 - DNA, 620 bp, Homo sapiens
  misc_feature: GZ8MTXP02HMC4P.38.4.A04.1.454.CMB.2.raw
  modified_base (232)..(232): a, c, t, g, unknown or other
  modified_base (281)..(282): a, c, t, g, unknown or other
  modified_base (287)..(287): a, c, t, g, unknown or other
  modified_base (295)..(295): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcaccttttagtaactatttaatgagctgggtccgccagcctccgagggaagggctggagtgggtgccagcattaaccaagatggacgtagaaaaatctatgtgactntgtgaaggccattcgcatctcagagacaacgcaaagaactcactgtgcnncacanagacgcgngagagacgacgacgacgcgtgtgtacttcgtgtgacgacgaccgacccgaccgtaggacggacgtacgaggtaggacgtcgtacgtacgttacgtacgtacgtacgggaccggaaccggaaccgtacgtaccgtaccgtcctcctaccgaccgaccctacccgaacccgaaccggacccgtaccgtccgttcccgttccccgtccgtaccctaccctaccctaccgaacgacgaccgaccgtcggtcgggacgacgacgccggccgcggcgtcgcgtcgtacgaacgtacgtaaccgtaccgacgtacgacgtacgacgacgcgg

SEQ ID NO: 398448 - DNA, 669 bp, Homo sapiens
  misc_feature: GZ8MTXP02HBW6V.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatcgtggtagggacagagtcaccatcacttgccgggcagtcagggcagttaggacttcgttagcctggtatcaagaccaaaaaaccgagggaaaccgccccctaaacctcctagatctagtggtagctactcctattttagacgtaaaggtcgggtacccagtcgaaaggttcaggcgacagtgatcgtagggacagtatcagtctacaacaatcaagcacgcccgtagccgacgtaccgtaggaactactaaccgtagtaacctaaaacttttaacgtttaacggtacgtttaacaaaaccgtaaggtttaaccttttaaaaattacggttttaacttacctttaccgttaaccgggttttaccgggggaaccggggttaaaacggggaaacccgtaaacgggttacgaaacgtaaactaaaccgtaaaacgtaacgttcggtaggacctaagtaccgaacccttatccttacgttcctttactacccg

SEQ ID NO: 398449 - DNA, 524 bp, Homo sapiens
  misc_feature: GZ8MTXP02HBB40.38.4.A04.1.454.CMB.2.raw
  modified_base (297)..(297): a, c, t, g, unknown or other
  modified_base (389)..(389): a, c, t, g, unknown or other
  modified_base (394)..(394): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactattaatgagctgggtccnccagcctccgagggaggggctggagtgggtgccagcataaccagatggacgtagaaaaatctatgtggactcgtgtgaagggcatcgcatcncaganacacgacaagactcactgtgctgcacatgaaccgcgtagagacggcgacgacgacggctgtcgtacttctggtcgcgacgaccgcccccgagtacggaacgggctacgaggtggacgtccgtacgttacg

SEQ ID NO: 398450 - DNA, 540 bp, Homo sapiens
  misc_feature: GZ8MTXP02F0BQI.38.4.A04.1.454.CMB.2.raw
  modified_base (300)..(300): a, c, t, g, unknown or other
  modified_base (332)..(332): a, c, t, g, unknown or other
  modified_base (397)..(397): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactatttaatgagctgggtccnccagcctccgaggggaaggggctggagtgggngccagcataaccaagatggactagaaaaatctatgtggactctgtgaagggccgattcgccatcnccagagacaacgccaagaactcactgtgctgacacatagaaccgggcctaggaggaggcgaacggacacggtctggttctacttgtcgtacgacgacgaccgccccagtcggacggactacggaggtcgggacgtacgtaacg

SEQ ID NO: 398451 - DNA, 571 bp, Homo sapiens
  misc_feature: GZ8MTXP02IVWJ4.38.4.A04.1.454.CMB.2.raw
  modified_base (256)..(256): a, c, t, g, unknown or other
  modified_base (331)..(331): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatcnccagagacaacgcaaagactcactgtggctgcacatgaacggcctgagagggcgagacacggctgtgtacttcgngtgcgagacgccccccatgagggctacgaggtgggganctacgacttttggacttacgtgggggacccaagggtaaccctggtccaccgtctcctcacgccctcaccgaacgggcccagttccggtccttcccccgtggccctacccctcctaccaacgcgccaccgtcgtcgggggcacgacgccggccgtgggctcgcgtcgtacaggactaaccgtcgacgtcgactcgactcgcgg

SEQ ID NO: 398452 - DNA, 639 bp, Homo sapiens
  misc_feature: GZ8MTXP02I0SM6.38.4.A04.1.454.CMB.2.raw
  modified_base (262)..(262): a, c, t, g, unknown or other
  modified_base (271)..(271): a, c, t, g, unknown or other
  modified_base (295)..(295): a, c, t, g, unknown or other
  modified_base (409)..(409): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctccaggtgccggatgtgacatccagttggcccagtctccatccttctgtctgcatctggtaggggacagagtcaccatcacttgccggcagtcagggcagttaggactcgtttagccgtggtatcagaccaaaaacgngggaaaccncccctaactcctagatctatggtncatcctagtttgacgtaaaggtcgggtaccagtacgaaaggttccaaggcggacagggtgactcggtaggaactagtacgttcaaggttccacaactagacacggacacgcccngacgacgtcgtaggaactacgtacgtacgtacttaactttattacgttacgtactaacgtaacgtttaaccttaaaccgttaacccgttacccgttaaggttaccggttacggaaccggtaacggtaacgtaagggttacggaaacgtaacgtaaaccgtaaacggtacgtacggtacgtactaccgaaccgtactacgttccgtacgtttaccttacgttaccttaccg

SEQ ID NO: 398453 - DNA, 594 bp, Homo sapiens
  misc_feature: GZ8MTXP02IMTTH.38.4.A04.1.454.CMB.2.raw
  modified_base (362)..(362): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaatactatgtggactctgtgaagggccgattcgccatctccagagacaacgccaagaactcactgtggctgcacatgaacggcctgagaggcgacgacacggctgtgtacttctgtgcgagacgcccccagtgagggctacgngtggganctagactttgactacgtggggaccagggaaccctggtcaccgtctcctcacgccctcaccgaacgggcccagtccgtccttccccgtggccaccctctacccaagcgcacctcggtgggggccaacgcggtccggccccgttggggcccttcggcccgttcggggtaccaaacgggaccttaaccgttcccgaaccgttgaacgttccgaaccgttggaccgggg

SEQ ID NO: 398454 - DNA, 606 bp, Homo sapiens
  misc_feature: GZ8MTXP02HMPQ5.38.4.A04.1.454.CMB.2.raw
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaaatactatgtggactctgtgaaggccgattcgccatctcagagacaacgccaagaactcactgtggctgcacatgaacggcctgagaggcgacgacacggctgtgtacttctgtgcgagacgcccccatggaggctacgagtgggganctaacgtactttgacctacgtgggggaccctaagggaaccctggtccacccgtcctcctcacgccctacccaaccgaaacgggcccaacgtccggtcccttcccccgtcggcccaccccttccaccaaacgacgccacctcgcgggggccacgacgccggccccgtgggcctcggccgtcggtaccaaacggacctaaccgttccaaccggttgaacgtcgtaaccgtacggacgg

SEQ ID NO: 398455 - DNA, 556 bp, Homo sapiens
  misc_feature: GZ8MTXP02ISR85.38.4.A04.1.454.CMB.2.raw
  modified_base (302)..(302): a, c, t, g, unknown or other
  modified_base (546)..(546): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctggagactctcctgtgcagcctctgcattcacctttagtaacttatttaatgagtcgtgggtccnccagccctccgagggaaggggctggagtgggtggccagcattaaccaagataggacgtagaaaaatctaatgtaggactcgtagtaggaacgggccagttcgctatctccagacgacaacgacaaagactcacgtgtgctgaccacgatcgacggacctgacgaggacgacgacgacggtctgttacgtacttcgtgtcgcggacgaccgcccccagtcgaacgggctacgaggtacggggacncgttagtcgg

SEQ ID NO: 398456 - DNA, 566 bp, Homo sapiens
  misc_feature: GZ8MTXP02GQLPJ.38.4.A04.1.454.CMB.2.raw
  modified_base (369)..(369): a, c, t, g, unknown or other
  modified_base (387)..(387): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaagggccgattcgccatctccagagacaacgccaaagaactcactgtggctgcacatgaacggcctgagaggcgacgacacggctgtgtacttctgtgcgagacgcccccatgagggctacaggtgganctacgactttgactacgnggggccacgggaaccctgtcaccgtctcctcacgcctccaccgaacgggcccacgtccggtcccttcccctcggccacccctccctaccaacgcgacacctcgtcgggggcacgcgccggcccgtgggcctgccgtcgtccgaaggacctaacgttccgacgtgactcgacgtgacggg

SEQ ID NO: 398457 - DNA, 557 bp, Homo sapiens
  misc_feature: GZ8MTXP02FLJ3S.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactcgttagcctggtatcagacaaaaaccagggaaacgccccctaacctcctgatctatggtgcatccattttgctaaagtggggtcccagtcaaagtcagcggccagtgatcgtgggacagtattcagtctcacaatcaagcagcctgcagcctaggagatactgactaactttattattgtctacagtacttaaatacgttaacccccatacgttttacggaccgtaacggggaccgtaaaggttcgggaagacttaaccgaaaacgtaaccgttaggtacggacttcggaacgaccctattccttgtacctttcactttccccg

SEQ ID NO: 398458 - DNA, 563 bp, Homo sapiens
  misc_feature: GZ8MTXP02JA5JQ.38.4.A04.1.454.CMB.2.raw
  modified_base (297)..(297): a, c, t, g, unknown or other
  modified_base (427)..(427): a, c, t, g, unknown or other
  modified_base (436)..(436): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcaccttagtaactattaatgagctgggtccnccagcctcgagggagggctggagtgggtgccagcataaccaagatggaccgtagaaaaatctatgtaggactcgtggtaggaaggggccgattcgccatcctccagacgacaacgccaaagactcactgnggctgccanatgaacggcctagagacgggcgacgacgacggctgtcggtacttcgtggtcggacgacggccgtaccccccgagtcgggaacggggtcctacgaaggggtcggggacgtacgttaacggttaaccgg

SEQ ID NO: 398459 - DNA, 594 bp, Homo sapiens
  misc_feature: GZ8MTXP02JOXST.38.4.A04.1.454.CMB.2.raw
  modified_base (373)..(373): a, c, t, g, unknown or other
  modified_base (428)..(428): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccggcagtcagggcattaggactcgttagcctggtatcagacaaaaaccgagggaaacgcccctaacctcctgatctatggtgcatcctattttgacaaaaggtcggggtacccagtcaaggttcaggcggccgagtggatcgtagggacagattcagtctcanatcagcagcctgcagccgtaggagatacgtgactaactttattattagtactaanagttacttaaattaccgttaaccccctaacttaccgttttacggacccggtaacgggggtaaaccctaagggtttacggaacgtaacgtaaccgaaaacgtaccgttaggtacgggtctacggaaccgtaccgtaacgttctacgttcctttactaactttccccg

SEQ ID NO: 398460 - DNA, 623 bp, Homo sapiens
  misc_feature: GZ8MTXP02JUDP3.38.4.A04.1.454.CMB.2.raw
  modified_base (319)..(319): a, c, t, g, unknown or other
  modified_base (340)..(340): a, c, t, g, unknown or other
  modified_base (360)..(360): a, c, t, g, unknown or other
  modified_base (538)..(538): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccattcgccatctcagagacaacgccaagaactcactgtggctgcacatgaacgctgagaggcacgacacggntgtgtacttctgtgcgagacncccccagtggagggctacgnggtgggatcgtacgtatttcgaacttacgtcgggggacccaacggggtaaccctcggtacctacccggtcctccctcgacgcccctacccgaaccgaaccgggcccctaacgttcccgggtccctttcccccgtcggcccctaccccttccctaccgaacgacgcccacccgttcggngggggaccaccggacggtccggcccgtggggccttcgaccgtcggtacgaacggtctaacgtccgacgtcgactcgactcgcggg

SEQ ID NO: 398461 - DNA, 601 bp, Homo sapiens
  misc_feature: GZ8MTXP02I2RL7.38.4.A04.1.454.CMB.2.raw
  modified_base (343)..(343): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccattcgccatctccagagacaacgcaaagactcactgtggctgcacatgaacggcctgagaggcgacgacacggctgtgtacttctggtgcgacgtacncccccaagtggaacggggtctaacgagggtgggatctaacgtactttgacttacgtgggggcccaagggaaccctggtccacccgtctccctcacgccctaccgaaccgaacgggccccagttcccggtccctttcccccgcggccaccccttccacccgaacgacgccaccgttcggtcgggggaccacgacggccggccgtcgggcgtcgccgtcggtacaacggacctaacttccacgtgactcgaccgtgacgg

SEQ ID NO: 398462 - DNA, 585 bp, Homo sapiens
  misc_feature: GZ8MTXP02GPK26.38.4.A04.1.454.CMB.2.raw
  modified_base (360)..(360): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccattcgccatctccagagacaacgcaagaactcactgtggctgcacatgaacggtctggagaggcgacgacacggctgtgtacttctgtgcgagacgcccccagtggaggctacgnggtggganctacgactttgactacgtggggccagggaccctggtccaccgtctcctcacgccctccaccgacgggcccacgtccggtcccttccccgtcggccctacccctccctaccaacgacgccaccgtcgtcgggggccacgacggccggcccgtgggcctcggccgtcggtaccgaacggtacctaaccgttccgacgtcgacgtcgacgtacggacggg

SEQ ID NO: 398463 - DNA, 682 bp, Homo sapiens
  misc_feature: GZ8MTXP02H6FB3.38.4.A04.1.454.CMB.2.raw
  modified_base (238)..(238): a, c, t, g, unknown or other
  modified_base (264)..(264): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgaggggaaggggctggagtgggtggccagcattaaccaagatggacgtagaaaaatctatgtggactntgtgaaggccattcgccatctcaganacaacgcaagaactcactgtgctgcacatgaacgctgagaggcgacgacacggctggtgtacttcgtggtgacgagacgcccccagtggaggcctagaggtggggactctaacggtactttggaaccttacggtgggggaccctaacggggaaacccctcggtcctacccggtcctaccctccgaacggcccctacccgaacccgaaaccggggccctaacgttcccgggttccctttccccccgttcgggccctacccccgttccctacccaaacggaccaccgaacccgttccggtacgggggccaaccggtacggcccgggcccggtcgggggccttaccggcccgttcggtaccgaaacgggacccttaaccttacccggaaccgttggacgttccggaccgtacggaccgggg

SEQ ID NO: 398464 - DNA, 577 bp, Homo sapiens
  misc_feature: GZ8MTXP02JZMS7.38.4.A04.1.454.CMB.2.raw
  modified_base (376)..(376): a, c, t, g, unknown or other
  modified_base (408)..(408): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgtttagcctggtatcagacaaaaaccgagggaaacgccccctaacctcctagatctatggtgcatcctattttgacgtaaaggtcggggtcccatcgaaggttcaggcggcagtgatcgtggacagtattcagtctacaanaatcagcagcctgacacgccgtaggagatacngtactaacttattattgtactacgtagtacttaactaccgtacccctagttaccgtttcggaccgtacggggacctaaggttacggaagtactaaccgtaaaacggtacgtaggtcggtactacgaaccgtaaccttacgtcgttacgttaccttacctaccgttcccg

SEQ ID NO: 398465 - DNA, 598 bp, Homo sapiens
  misc_feature: GZ8MTXP02JAR7J.38.4.A04.1.454.CMB.2.raw
  modified_base (354)..(354): a, c, t, g, unknown or other
  modified_base (361)..(361): a, c, t, g, unknown or other
  modified_base (378)..(378): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccattcgccatctccagagacaacgcaagaactcactgtggctgcacatgaacggcctgagaggcgacgacacggctgtgtacttctgtgcgagacgcccccatgaggctacngtggganctacgctttgactacgnggggaccagggaccctggcaccgtctcctcacgcctccaccgaacgggcccacgtccggtcccttcccccgtcggcccacccctcctacccaacgacgccacccgtcgtcgggggaccaccgacggccgggcccgtcggggcccttcggcccgttcggtaccgaacgggtaccttaaccgttacccaacggttcgaacgttccgaccgtaggaaccgggg

SEQ ID NO: 398466 - DNA, 600 bp, Homo sapiens
  misc_feature: GZ8MTXP02GEHKR.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaaatactatgtggactctgtgaagggccgattcgccatctccagagacaacgccaagaactcactgtggctgcacatgaacggcctgagaggcgacgacacggctgtgtacttctgtgcgagacgcccccatggagggctacgaggtgggatctacgactttgacctacgtgggggccagggaccctgtccaccgtctcctcacgccctccaaccgaacgggcccagtccggtcccttccccctcggcccaccccgtccctacccgaacgcgccacccgtcggtcgggggccacgacggccggcccgtgggcctcggcccgtcgggtaccaacggtacctaaccgttcccgaacggttcgacgtaccggacgtggacgg

SEQ ID NO: 398467 - DNA, 548 bp, Homo sapiens
  misc_feature: GZ8MTXP02FP9KC.38.4.A04.1.454.CMB.2.raw
  modified_base (322)..(322): a, c, t, g, unknown or other
  modified_base (486)..(486): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggagcttggtccaggccggggggtccctgagactctcctgtgcagcctctgcattcacctttagaactatttaatgagctgggtccgcagcctccgagggagggctggagtgggnggccagcataaccagatggaccgtagaaaatctatgtaggactctgtgaagggccgattcgccatctccagagacacgcccaagacctcacgtgtaggctggaccacagtcgaaaccgggcctaggaagacgggacgacggaccgacggcctgtcgtacgttcnggtcgccgaagcgccccccaaggcggaacggactacggaggtacggacgtaccgtacgtacg

SEQ ID NO: 398468 - DNA, 567 bp, Homo sapiens
  misc_feature: GZ8MTXP02G0SKT.38.4.A04.1.454.CMB.2.raw
  modified_base (288)..(288): a, c, t, g, unknown or other
  modified_base (300)..(300): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactatttaangagctgggtccnccagcctccgaggggaaggggctggagtgggtggccagcataaaccaagatggacgtagaaaaatactatgtggactcgtggtaggaaggggccgtagttccgccatcctaccagacgaacaacgacccaaagactcactgtggactgacacatacgaacgggtccaggagacgggcgaacggtacaacgggctggtacgtactttcgtgtcgacgacgaccgcccccaagtggacgggactacggaggtcgggactacgttaacgg

SEQ ID NO: 398469 - DNA, 523 bp, Homo sapiens
  misc_feature: GZ8MTXP02GA9H2.38.4.A04.1.454.CMB.2.raw
  modified_base (298)..(298): a, c, t, g, unknown or other
  modified_base (361)..(361): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctggagactctcctgtgcagcctctgcattcacctttagtaactattaatgagctgggtccnccagcctccgagggagggctggagtgggtgcagcataaccagatggaccgtagaaaatcatgngactctgtgaagggccgattcgccatctccagagacaacgccaaagactcactgtgctgcacatgaacgcctagagaggcgacgacgacggctgtcgtacttcgtggtcgcgacgccgacccccagtcggaagggctaacgaggtggacgtcgtacgttacg

SEQ ID NO: 398470 - DNA, 585 bp, Homo sapiens
  misc_feature: GZ8MTXP02JFKFX.38.4.A04.1.454.CMB.2.raw
  modified_base (335)..(335): a, c, t, g, unknown or other
  modified_base (363)..(363): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtgaaaaatactatgtggactctgtgaagggccgattcgccatctccagagacaacgccaaagaactcactgtggctgcacatgaacggcctgagaggcgacgacacggctgtgtacttcngtgcgagacgccccccatgagggctacngtgggganctacgactttgacttacgtgggggccagggaaccctggtccaccgtctcctcacgccctaccacccaacgggcccagttccggtccttcccccgtcggccacccctcctcccaagacgccacccgtcgtcgggggcacgagccggcccgtggggcctcgcccgtggtacgaacggtacctaacgttcccacgtcgacttccggacgtcgacggg

SEQ ID NO: 398471 - DNA, 548 bp, Homo sapiens
  misc_feature: GZ8MTXP02JO0Y5.38.4.A04.1.454.CMB.2.raw
  modified_base (298)..(298): a, c, t, g, unknown or other
  modified_base (327)..(327): a, c, t, g, unknown or other
  modified_base (420)..(420): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggcccggggggtccctgagactctcctgtgcagcctctgcattcacctttagtaactatttaatgagctgggtccnccagccctcgagggagggctggagtgggngccagcattaaccaagatggaccgtagaaaaatctatgtggactcgtgtgaagggccagttccgccatctccagacgacaacgccaaagaccncactgtcgctgcacagtacgaacggcctaggagacggacgaacgacgtacggctagtcgtacttcgtggtcgcgacgaccgcccccagtcggaacgggctaacgaggtacggacgtacgtacgtaccg

SEQ ID NO: 398472 - DNA, 536 bp, Homo sapiens
  misc_feature: GZ8MTXP02GLFEE.38.4.A04.1.454.CMB.2.raw
  modified_base (295)..(295): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctatttagaaggtgtcagtgtgaggtgcaactggtggagtcgtgggggaggcttggtccaggccgggggggtcctgagactctcctgtgcagcctctgcattcacctttagtaactatttaatgagctgggtccnccagcctccgagggagggctggagtgggtgccagcattaaccagatggacctagaaaaatactatgtggactctgtggagggccgattcgccagtctccagagacaacgaccaagactcactgtgctgcacatgaacgccagagacggcgacgacgacggctggtcgtacgttcgtggtcgcgaacggaccgaccccccgagtcggaacgggcttacgacggtgggacgcgtacgttaacg

SEQ ID NO: 398473 - DNA, 583 bp, Homo sapiens
  misc_feature: GZ8MTXP02FVME4.38.4.A04.1.454.CMB.2.raw
  modified_base (309)..(309): a, c, t, g, unknown or other
  modified_base (361)..(361): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaaagaactcactgtggctgcacatgaacggcctgagnggcgacgacacggctgtgtacttctgtgcgagacgcccccatgaggctacgngtggganctacgactttgactacgtgggggccagggaaccctggtccaccgtctcctcacgccctcaccaacgggcccactccggtcccttcccccgtcgggcccacccctcctacccaacgacgccacccttcgcgggggcacgacggccggcccgtgggcctcgccgtcggtaccgaaggtacctaacgttcccgaacgttcgacgttcgactgacgggg

SEQ ID NO: 398474 - DNA, 535 bp, Homo sapiens
  misc_feature: GZ8MTXP02JWJP0.38.4.A04.1.454.CMB.2.raw
  modified_base (298)..(298): a, c, t, g, unknown or other
  modified_base (425)..(425): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctggagactctcctgtgcagcctctgcattcacctttagtaactattaatgagctgggtccnccagcctccgaggggaggggctggagtgggtgccagcataaccaagatggaccgtagaaaaatctatgtggactcgtgtggaaagggccgattcgccatcctcagagacaacgccaagactcactgngctgcacatgaacgcctagagaggcgacgacgacggctgtgtacttctgtcggcgacggaccgccccccagtcggaacgggctacgacggtgggacgtccgtacgttacg

SEQ ID NO: 398475 - DNA, 563 bp, Homo sapiens
  misc_feature: GZ8MTXP02G47SE.38.4.A04.1.454.CMB.2.raw
  modified_base (331)..(331): a, c, t, g, unknown or other
  modified_base (386)..(386): a, c, t, g, unknown or other
  modified_base (451)..(451): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccagggagggctggagtgggtggccagcattaaccaagatggacgtagaaaaatctatgtggactctgtgaaggccgattcgccatctccagagacaacgccaagactcactgtggctgcacatgaacggcctgagaggcgacgacacggctgtgtacttcgngtgcgagacgcccccagtgagggctacgaggtgggagctagactttgacttacgngggggccagggaaccctggtccaccgtctctcagcctccacaggcccatccggtccttcccccgnggaccacccctcctaccaacgacgccaccgtcgtcgggggacacgacggccgcccgtggcctcgccgttcggacaacggtacctaacgttccgacgtgactcgacgtgacgg

SEQ ID NO: 398476 - DNA, 578 bp, Homo sapiens
  misc_feature: GZ8MTXP02FWKGG.38.4.A04.1.454.CMB.2.raw
  modified_base (363)..(363): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccattcgccatctccagagacaacgccaaagaactcactgtggctgcacatgaacggcctgagaggcgacgacacggctgtgtacttctgtgcgagacgcccccatgagggctacgnggtggganctacgactttgacctacgtgggggcccaagggaaccctggtccacccgtctccctcacgccctaccaccgaacgggccccagtccggtcccttcccccgcggcccacccctcctacccaaacgcgccaccgttcggcggggccacgcgccggccgtggcctcgccgtcgacaacggactaaccgtcacgtcgactcgacgtcgacgg

SEQ ID NO: 398477 - DNA, 553 bp, Homo sapiens
  misc_feature: GZ8MTXP02GK50U.38.4.A04.1.454.CMB.2.raw
  modified_base (264)..(264): a, c, t, g, unknown or other
  modified_base (292)..(292): a, c, t, g, unknown or other
  modified_base (305)..(305): a, c, t, g, unknown or other
  modified_base (450)..(450): a, c, t, g, unknown or other
  modified_base (531)..(531): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggcccgggggggtccctggacgactctcctgtgcagcctntgctattcacctttagtaactatttaangagcgtgggtccnccagccctcgaggggagggctggagtgggtgccagcataaccaagatggaaccgtagaaaaatctatgtaggactcgtgtaggaacggggccattcgcctatcctccagagaacaacgaccaaagactcactgtacgctgccaanatgaacgctagacgaggcgacgacgacgtcgtgtgtacttcgtggtcgacgacgaccgcccccagtcggaacggctaacgnggtacgggactcgtacgttacg

SEQ ID NO: 398478 - DNA, 538 bp, Homo sapiens
  misc_feature: GZ8MTXP02IYGG3.38.4.A04.1.454.CMB.2.raw
  modified_base (298)..(298): a, c, t, g, unknown or other
  modified_base (423)..(423): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtcctgagactctcctgtgcagcctctgcattcacctttagtaacttatttaatgagctgggtccnccagcctccgaggggaggggctggagtgggtggccagcattaaccaagatggaccgtagaaaaatctatgtggactctgtgaaggggccattcgccatctcagagacaacgacaagactcactgnggctgcacacgtgaaccggccgtagacgaggacgacgacgacggctgtgtacttctgtcgcgacgacgacccccgagtcggaacgggctacgacggtgggacgtcgtacgttacg

SEQ ID NO: 398479 - DNA, 524 bp, Homo sapiens
  misc_feature: GZ8MTXP02JDPEN.38.4.A04.1.454.CMB.2.raw
  modified_base (509)..(509): a, c, t, g, unknown or other
  modified_base (518)..(518): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactatttaatgagctgggtccgccagcctccgaggggaaggggctggagtgggtggccaggcattaaccaagatggacgtagaaaaatactatgtgctctgtgaagggccattcgcatctccagagacaacgccaaagaactcactgtggctgcacatcgaacggcctgagaggcgacgacacgggctggtcgtacttctgtgccgagaccgcccccagtggacgggctacnggtcggacnctaacg

SEQ ID NO: 398480 - DNA, 627 bp, Homo sapiens
  misc_feature: GZ8MTXP02F9END.38.4.A04.1.454.CMB.2.raw
  modified_base (237)..(237): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaaggggctggagtgggtggccagcaattaaccaagatggacgtagaaaaatctatgtgactntgtgaaggccattcgcatctcagagacaacgcaaagactcactgtgctgcacatgaacggctgagaggcgaacgacacggcttgtcgttacttctggtgcgagaccgcccccagtggacggactacgaggtgggactccgtacgtactttggacctacggtcgggggacctaagggaacccgtggtccaccgtcctcctcgacgccctaccgaaccgacgggccccacgttcccgggttccccttcccccgcgtacccctaccccttcccaccgaaacgccgacctacccgtcggcggggaccacgcggcccggtccgtgggcctcgccgtacgtaccgaaggtaccttaaccgttaccgacggttacgaccgtacggacgtggaccggg

SEQ ID NO: 398481 - DNA, 525 bp, Homo sapiens
  misc_feature: GZ8MTXP02FT8IN.38.4.A04.1.454.CMB.2.raw
  modified_base (296)..(296): a, c, t, g, unknown or other
  modified_base (444)..(444): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactattaatgagctgggtccncagcctccgagggaggggctggagtgggtgccagcataaccagatggacgtagaaaaatcatgtggactcgtgtaggaagggccattcgccatcctcagagacaacgccaaagacctcactgtgctgcacatgaacggcctaggacgnggcgacgacacggctgtgtacttctggtcgcgacgccgcccccagtggaacgggctaacgagggtggacgcctacggttac

SEQ ID NO: 398482 - DNA, 535 bp, Homo sapiens
  misc_feature: GZ8MTXP02IG9N5.38.4.A04.1.454.CMB.2.raw
  modified_base (295)..(295): a, c, t, g, unknown or other
  modified_base (438)..(438): a, c, t, g, unknown or other
  modified_base (447)..(447): a, c, t, g, unknown or other
  modified_base (454)..(454): a, c, t, g, unknown or other
  modified_base (458)..(458): a, c, t, g, unknown or other
  modified_base (476)..(476): a, c, t, g, unknown or other
  modified_base (495)..(495): a, c, t, g, unknown or other
  modified_base (503)..(503): a, c, t, g, unknown or other
  modified_base (524)..(524): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtcctgagactctcctgtgcagcctctgcattcaccttagaactattaatgagctgggtccnccagccctccgaggggaagggctggagtgggtggccagcaataaaccaagatggaccgtagaaaaaatctatgtggactcgtgtagaaagggcccattcgacctatctccaagacgaacaaacgacccaaagaacctcactgngctgcacangaacgcngagngcgacgacgacggctagngtactgtgcgacgagaccnccccctanggaacggcacgaggtgggacncgttacgtacg

SEQ ID NO: 398483 - DNA, 552 bp, Homo sapiens
  misc_feature: GZ8MTXP02ILIR9.38.4.A04.1.454.CMB.2.raw
  modified_base (366)..(366): a, c, t, g, unknown or other
  modified_base (450)..(450): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaaccaagatggacgtagaaaaatactatgtggactctgtgaagggccgattcgcatctccagagacaacgccaagaactcactgtggctgcacatgaacggcctgagaggcgacgacacggctgtgtacttctgtgcgagacgcccccatgaggctacaggtgganctacgactttgactacgtggggaccagggaccctggcacgtctcctcagccctcaccgaacgggcccagtccggtccttccccncggccacccctctacccaagacgccacctcgtcggggacacgacggcggcccgtgggctcgccgtcggtacaaggactaacgtcacgtcgatcgactgacgg

SEQ ID NO: 398484 - DNA, 545 bp, Homo sapiens
  misc_feature: GZ8MTXP02JEVMA.38.4.A04.1.454.CMB.2.raw
  modified_base (293)..(293): a, c, t, g, unknown or other
  modified_base (527)..(527): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggactcgttagcctggtatcagacaaaaaccgagggaaacgccccctaactcctgatctatggtncatccatttgacaaaggtcgggtccatcaagttcagcggcagtgatctgggacagattcagtctacacaatcagcagcctgcagcccgtggagtatactgactaacgtttattattgtctaacagtactttaaataccgtttaacccccattacgttttcggacccgtagggggaacctaaaggttcggacgaatacgaaaacgtacgtgtaggctacgcgtacctaattcgtntttacctactacttcccg

SEQ ID NO: 398485 - DNA, 548 bp, Homo sapiens
  misc_feature: GZ8MTXP02HJUUH.38.4.A04.1.454.CMB.2.raw
  modified_base (298)..(298): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactatttaatgagctgggtccnccagcctccgaggggaagggctggagtgggtggccagcattaaaccaagatggaccgtagaaaaatctatgtggactcgtgtggaagggccattcgccatctccagacgacaacgaccaaagactacacgtgtcggctgcaacagtacgaaccggcctaggaacgacgggacgaacgacgacggctgtcgtacttctagtcgacgacgaccgcccccagtgaagggctacgaggtggacgcgtacgtacg

SEQ ID NO: 398486 - DNA, 596 bp, Homo sapiens
  misc_feature: GZ8MTXP02JXF33.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccattcgccatctccagagacaacgccaagaactcactgtggctgcacatgaacggcctgagaggcgacgacacggctgtgtacttctgtgcgagcgcccccagtgagggctacgaggtgggagctaacgactttgactacgtgggggaccagggaaccctggtccaccgtctccctcacgccctccaacccgaacgggccccacgtccgggttccctttcccccgtcggccctaccccgtccctacccgaaacgacgccgacccgtcgtcgggggccacgacggccggcccgtgggcctcggccgtcggtacaacggacctaaccgttccacgtcgactcgacgtgacggg

SEQ ID NO: 398487 - DNA, 594 bp, Homo sapiens
  misc_feature: GZ8MTXP02FUNCO.38.4.A04.1.454.CMB.2.raw
  modified_base (362)..(362): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaaccaagatggacgtagaaaaatctatgtggactctgtgaagggccgattcgccatctccagagacaacgcaaagactcactgtgctgcacatgaacggcctgagaggcgacgacacggctgtgtaccttctgtgcgagaccgcccccatggagggctacgnggtggggancgtacgactttgactacgtgggggccagggaacccgtggtcaccgtctcctcacgccctaccaccgaacgggcccacgtccggtcccttcccccgtcggcccacccctccctaccgaacgacgcaccgtcgcgggggacacgacgccggcccgtgggcctcgccgtacggtaccgaaacggtacctaaccgttacccgacgtacgacgtacgaccgtggacgg

SEQ ID NO: 398488 - DNA, 538 bp, Homo sapiens
  misc_feature: GZ8MTXP02G5SYW.38.4.A04.1.454.CMB.2.raw
  modified_base (299)..(299): a, c, t, g, unknown or other
  modified_base (401)..(401): a, c, t, g, unknown or other
  modified_base (426)..(426): a, c, t, g, unknown or other
  modified_base (439)..(439): a, c, t, g, unknown or other
  modified_base (457)..(457): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactatttaatgagctgggtccnccagcctccgagggagggctggagtgggtgccagcattaaaccaagatggaccgtagaaaaatactatgtggactcgtgtagaaggggccattcgccatccnccagacgacaacgaccaaagacctnactgtcgctgcanatagaaccggcctgaagnggcgaacgacacggtctgtcgtacttcgtgtcgcgacgaccgcccccatcggaacggctacgacggtggacgctacgtacg

SEQ ID NO: 398489 - DNA, 519 bp, Homo sapiens
  misc_feature: GZ8MTXP02FIYT0.38.4.A04.1.454.CMB.2.raw
  modified_base (297)..(297): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactattaatgagctgggtccncagcctccgagggagggctggagtgggtggccagcattaaccaagatggaccgtagaaaaatctatgtggactctgtgaagggccgattcgccatctcagagacaacgcaagactcactgtgctgcacatgaacggctgagaggcgacgacacggctgtcgtacttcgtgtcgcgacgacgcccccagtcggaacgggctacgaggtgggagcgtacgtacg

SEQ ID NO: 398490 - DNA, 536 bp, Homo sapiens
  misc_feature: GZ8MTXP02HNK6I.38.4.A04.1.454.CMB.2.raw
  modified_base (301)..(301): a, c, t, g, unknown or other
  modified_base (408)..(408): a, c, t, g, unknown or other
  modified_base (436)..(436): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggcccgggggggtccctggagactctcctgtgcagcctctgcattcacctttagtaactattaatgagctgggtccnccagccctccgaggggaaggggctggagtggggtgccaggcattaaaccaagatggaccgtagaaaaatctatgtggactcgtgtgaagggcattcgcatctcaganacaacgccaaagactcactgtgctgcanatagaacgcctagagaggcgacgacacggctgtcgtacttcgtggtcgcggacgaccgcccccagtggaacggctacgaggtagggcgacgtaacgtacg

SEQ ID NO: 398491 - DNA, 596 bp, Homo sapiens
  misc_feature: GZ8MTXP02I8S75.38.4.A04.1.454.CMB.2.raw
  modified_base (367)..(367): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaaggccattcgccatctccagagacaacgcaagactcactgtggctgcacatgaacggcctgagaggcgacgacacggctgtgtacttctgtgcgagacgccccccatgacgggctacgaggtgggganccgtacgactttgactacgtggggaccagggaaccctggtccaccgtctcctcacgccctccaccgaacgggcccatccggtcccttcccccgcggccacccctcctacccaaacgcgaccacccgtcgtcgggggaccaacgcggccgggcccgttcggggcctcggccgtcggtaccgaacgggtaccttaaccgtcccgacgttcgacgtacgaccgtggaccggg

SEQ ID NO: 398492 - DNA, 546 bp, Homo sapiens
  misc_feature: GZ8MTXP02INIJY.38.4.A04.1.454.CMB.2.raw
  modified_base (299)..(299): a, c, t, g, unknown or other
  modified_base (443)..(443): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctggagactctcctgtgcagcctctgcattcacctttagtaactattaatgagctgggtccnccagcctccgagggaaggggctggaggtggggtggccagcattaaaccagatggaccgtagaaaaatactatgtggactcgtgtgaaacggggccattcgccatcctccgagacgacaacgccaaagacctcactgtgctgcanatgaacgcagagaggcgacgacgacgcgtgtgtacttcgtggtcgcggacgccgacccccagtcggaacgggctaacgacggtgggacgtacgtacgtaacgg

SEQ ID NO: 398493 - DNA, 528 bp, Homo sapiens
  misc_feature: GZ8MTXP02J1K1B.38.4.A04.1.454.CMB.2.raw
  modified_base (402)..(402): a, c, t, g, unknown or other
  modified_base (415)..(415): a, c, t, g, unknown or other
  modified_base (465)..(465): a, c, t, g, unknown or other
  modified_base (504)..(504): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctggagaactctcctgtgcagcctctgcattcacctttagtaactattaatgagctgggtccgccagcctccgaggggaaggggctggagtggggtggccagcttaaaccaagatggacgtagaaaaatctatgtggactctgtgagggccattcgcatctcaganacaacgcaagacncactgtgctgcacatcgaacgcctaggagaggcgacgactacggctggtntacttcgtgtgcgagcgcccccagtcggacggctaacgnggtgggacgctacgtactttacgg

SEQ ID NO: 398494 - DNA, 578 bp, Homo sapiens
  misc_feature: GZ8MTXP02JO9E4.38.4.A04.1.454.CMB.2.raw
  modified_base (294)..(294): a, c, t, g, unknown or other
  modified_base (434)..(434): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaagtgtccagtgtgaggtgcaactggtggagtcgtgggggaggcttggtccaggccgggggggtcctgagactctcctgtgcagcctctgcattcaccttagtaactattaatgagctggtccnccagcctccgagggagggctggaggtgggtgccagcaattaaccaagatggaacgtagaaaaatctatgtgactcgtgtaggaacggggcctattccgctatcctaccagaacgacaacgacccaaagaacctacactgnggctggacacgatacggaaccggccgtaggaacgagggaccgacggacgacggtccgtagtacgttaccgttcgtggtcggacggacgacccgccccctacgtaggaacgggtctaacgaggtgggactaccgtaacgttaccg

SEQ ID NO: 398495 - DNA, 704 bp, Homo sapiens
  misc_feature: GZ8MTXP02I1263.38.4.A04.1.454.CMB.2.raw
  modified_base (238)..(238): a, c, t, g, unknown or other
  modified_base (319)..(319): a, c, t, g, unknown or other
  modified_base (391)..(391): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcaccttttagtaactatttaatgagctgggtccgccagcctccgaggggaaggggctggagtgggtggccagcattaaccaagatggacgtagaaaaatctatgtgactntgtgaaggcattcgcatctcagagacaacgccaaagactcactggtgctgcacatgaacgctggagaggcgacgacacggnttggtacgttactttcgtggtcgcgacgaccgcccccctaagtggaacgggtctaacggaggtcggggaacnccgttaaccgtacttttacggaaccttaccgggtcgggggacccaaacggggtaaaccccgttcgggtaccctacccgtcctcccgtaccaccgtccccctaacccgaacccgaaccgggcccctacgttcccgggttccccttcccccgtcgggtccctaacccccgttccctaacccgaacgaccgtcccgtaacccgttcggacgggggaccaaccgcggcccggtcccggtcggggcccgtcggtccgtcgggtacgaaaccggtaccttaaccgttacccgacgtcgaacgtccggacgtcggacggg

SEQ ID NO: 398496 - DNA, 595 bp, Homo sapiens
  misc_feature: GZ8MTXP02F7TWV.38.4.A04.1.454.CMB.2.raw
  modified_base (371)..(371): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccaggggaaggggctggagtgggtggccagcattaaccaagatggacgtagaaaaatctatgtggactctgtgaaggccgattcgcatctcagagacaacgccaagactcactgtggctgcacatgaacggcctgagaggcgacgacgacggctggtgtacttcgtggtgcgagacgcccccatggagggctacgaggtgggganctacgactttggactacgtgggggccaaggggaaccctggtccaccgtctcctcacgccctccgaccgaacgggcccacgtccggtcccttcccccgtcggccacccctcctaccgaacgacgaccaccgtcgtcgggggcacgacggccggcccgtggggcctcggccgtcgggtaccgaacggtacctaacgttcccacggttcgacgtcgacgtcgacggg

SEQ ID NO: 398497 - DNA, 563 bp, Homo sapiens
  misc_feature: GZ8MTXP02FSJG1.38.4.A04.1.454.CMB.2.raw
  modified_base (327)..(327): a, c, t, g, unknown or other
  modified_base (360)..(360): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccattcgccatctccagagacaacgccaagactcactgtgctgcacatgaacggcctgagaggcgacgacacggctgtgtacttcngtgcgagacgcccccatgaggctacaggtgganctacgctttgacttacgtgggggaccagggaaccctggtccaccgtctcctcacgccctccaccgaacgggcccagtccggtccttcccccgtcggcccacccctcctaccaaacgcgaccaccgttcgcgggggccacgacgccgcccgtggctcgccgtcggtcaaggtcctaacgttccgacgtgacgtcgacgtgacgg

SEQ ID NO: 398498 - DNA, 521 bp, Homo sapiens
  misc_feature: GZ8MTXP02IL7EK.38.4.A04.1.454.CMB.2.raw
  modified_base (258)..(258): a, c, t, g, unknown or other
  modified_base (266)..(266): a, c, t, g, unknown or other
  modified_base (285)..(285): a, c, t, g, unknown or other
  modified_base (289)..(289): a, c, t, g, unknown or other
  modified_base (398)..(398): a, c, t, g, unknown or other
  modified_base (421)..(421): a, c, t, g, unknown or other
  modified_base (475)..(475): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtagggacagatcaccatcacttgccgggcagtcagggcattaggacttcgttagcctggtatcagacaaaacngggaaacncccctaactcctgatctanggtncatcctatttgactaaaggtcgggtcccatcgaagttcagcggcaggtgatcgtaggacagtattcaagtctacaacatcagacagccctgcacgcgtaggagtatacngactaactttattattgtactangtacttaaactacctacccatacgtttcggaccgtagggactaagtcggaatanacgaaacgactggcgatcgaacactatcctgttctactacttcccg

SEQ ID NO: 398499 - DNA, 523 bp, Homo sapiens
  misc_feature: GZ8MTXP02HNFBL.38.4.A04.1.454.CMB.2.raw
  modified_base (255)..(255): a, c, t, g, unknown or other
  modified_base (263)..(263): a, c, t, g, unknown or other
  modified_base (283)..(283): a, c, t, g, unknown or other
  modified_base (287)..(287): a, c, t, g, unknown or other
  modified_base (371)..(371): a, c, t, g, unknown or other
  modified_base (385)..(385): a, c, t, g, unknown or other
  modified_base (387)..(387): a, c, t, g, unknown or other
  modified_base (397)..(397): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctccaggtgccggatgtgacatccagttggcccagtctccatccttctgtctgcatctgtaggggacagagtcacatcacttgccggcagtcagggcattaggactgtttagcctggtatcagacaaaaccngggaaacncccctaactcctagatctanggtncatccatttgactaaaggtcggggtccagtcgaaaggttcacggacggccagtcggatcgtagggacagtacttcgaagttcanacatacagcagccncncacgcgaganatactatactattattattatactactatactaactactacctactacgttacgtacgacgacgtaagtacgtagtataacgaactacgtacgtacgacgacaacgactactactactctctactc

SEQ ID NO: 398500 - DNA, 524 bp, Homo sapiens
  misc_feature: GZ8MTXP02GM45H.38.4.A04.1.454.CMB.2.raw
  modified_base (475)..(475): a, c, t, g, unknown or other
tcagtcgatcacgtcacgaccggtgctcgatttagagtagtgatcaggggtctcagagaggagccttagccctggactccaaggcctttccacttggtgatcagcactgagcacagaggactcaccatggaattggggctgagcgtgggttttccttgttgctattttagaaggtgtccagtgtgaggtgcaactggtggagtctgggggaggcttggtccaggccgggggggtccctgagactctcctgtgcagcctctgcattcacctttagtaactatttaatgagctgggtccgccagccctccgaggggaaggggctggagtgggtggccagcattaaaccaagatggactgaaaaatactaatgtggactctgtgaagggccgattcgccatctccagagacaacgccaaagaactcactgtggctgcacatgaacggctagagaggcgacgacaggctgtgtacttcngtgacgagacgccccccagtgaaggcgtacagtagggaggctacgtacg

SEQ ID NO: 398501 - DNA, 522 bp, Homo sapiens
  misc_feature: GZ8MTXP02JJKJ2.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactattaatgagctgggtccgccagcctccgagggagggctggagtgggtgccagcataaccagatggacgtagaaaaatctatgtggactctgtgaagggccgattcgcatctccagacgacaacgccaaagactcactgtagctgcacatgaacgcctgagacggcgacgacacggctgtgtacttcgtggtcgcgacgaccgcccccagtcggaacgggctacgaggtggacgctacggtacg

SEQ ID NO: 398502 - DNA, 620 bp, Homo sapiens
  misc_feature: GZ8MTXP02HS38I.38.4.A04.1.454.CMB.2.raw
  modified_base (284)..(284): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtagaaaaatctatgtggactctgtgaagggccgattcgccatctccagagacaacgccaagaactcactgngctgcacatgaacggcctggagagggcacgacacggctgtgtacttctgtgcgaagcgcccccatggagggctacgaggtggganctacgactttgactacgtgggggaccacgggaacccgtggtccaccgtctccctcacgccctcccaccgaacgggccccagtccgggtccctttcccccgtggaccctaccccttaccctacccgaaacgacgcctaccctcggtcgggggccaacgcggtcccggcccgttcgggggccctcggccttacggggtaccaaacgggccttaaccgttcccgaacggttcgacgttaccgaccgtggacggg

SEQ ID NO: 398503 - DNA, 586 bp, Homo sapiens
  misc_feature: GZ8MTXP02GRAO3.38.4.A04.1.454.CMB.2.raw
  modified_base (307)..(307): a, c, t, g, unknown or other
  modified_base (331)..(331): a, c, t, g, unknown or other
  modified_base (366)..(366): a, c, t, g, unknown or other
  modified_base (523)..(523): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaaagaactcactgtggctgcacatgaacggctgagnggcacgacacggctgtgtacttcngtgcgagacgcccccatgaggctacgaggtggganctacgactttgactacgtgggggccaagggaaccctggtcacccgtcctcctcacgccctccgaaccgaacgggcccacgtccggtcccttcccccgtcggcccacccctccctaccaaacgacgccacctcgtcgggggccacgacgccggcccgngggcctcggccgtcggtaccgaacggtactaaccgtaccgacgtcgactccgacgtacgacgg

SEQ ID NO: 398504 - DNA, 569 bp, Homo sapiens
  misc_feature: GZ8MTXP02HCGOL.38.4.A04.1.454.CMB.2.raw
  modified_base (299)..(299): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggccgggggggtcctggagactctcctgtgcagcctctgcattcacctttagtaactattaatgagctgggtccnccagcctccgaggggaagggctggagtgggtgccagcattaaccaagatggaccgtagaaaaatctatgtggactcgtgtaggaagggcccgtattccggaccctatcctacccaagacgaacaaacgcccaaaagaacctcaacgtgtaggctgacaacagtagaaccgccgtaggaacgaggcgaacgacgacggctgtcgtacttcgtgtcgacgacgaccgcccccaagtcggaacggcctacgacggtgggacgcgtacgttacg

SEQ ID NO: 398505 - DNA, 641 bp, Homo sapiens
  misc_feature: GZ8MTXP02GVDGD.38.4.A04.1.454.CMB.2.raw
  modified_base (360)..(360): a, c, t, g, unknown or other
  modified_base (367)..(367): a, c, t, g, unknown or other
  modified_base (386)..(386): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccgattcgccatctccagagacaacgccaagactcactgtggctgcacatgaacggcctgagaggcgacgacacggctgtgtacttctgtgcgagacgcccccatgaggctacgngtggganctacgactttgacctacgngggggccaaggggaaccctggtccacccgtctccctcgacgcccctccgaacccgaacgggcccctaagttccgggtcccctttccccccgcgggccctaccccctaccctacccgaaacggaccgaccctaacccgtccggtcgggggccaacgacggcccgggcccccgtggggcctcggcccgttcgggtaccgaaaccgggaccttaaccgttacccgacggttacgaacttccggaacgtcggaccgggg

SEQ ID NO: 398506 - DNA, 634 bp, Homo sapiens
  misc_feature: GZ8MTXP02GGR4K.38.4.A04.1.454.CMB.2.raw
  modified_base (261)..(261): a, c, t, g, unknown or other
  modified_base (359)..(359): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtgactctgtgaagggccattcgccatctccaganacaacgccaagactcactgtggctgcacatgaaccggctgagaggcgacgacacggctgtctacttcgtgtgcgagacgcccccagtggaggctacgnggtgggatcgtaacgtactttgaaccttacgggtcgggggacccaacggggtaaacccgttcggggtacccacccggtcctaccctcgacgtcccctacccaaccgaaaccggggccccaacgttcccggttcccttcccccgtcggcccacccccttccctaccaaacgacgaccacccgttcggcgggggaccacgaccggtccggccgtgggcctcgcgtcgtaccgaacggtacctaacgttccgacgttacgacgtcgacggtcgacggg

SEQ ID NO: 398507 - DNA, 598 bp, Homo sapiens
  misc_feature: GZ8MTXP02G5IDR.38.4.A04.1.454.CMB.2.raw
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcgttgggtccgagggccgggggggtccctggagactctcctgtgtagcctctgcattcacctttagtaacttattaatgagctgggtccncagcctcgaggggagggctggagtgggtgccagcaataaccaagatggacgtagaaaaaatctaagtgtaggacttcgtggtaggaaacggggcctaagttcgacctaatccctaccaagaagaacaaaccgaccaaaagaacctcaacgtggtcggctacggaccaacagttacggaaaccgggcctagggaagagggaccgaacgacgtacgggctggtcgttacttcgtgtcgacgacgaccgcccccagtcgacggggctacgagggtgggagtacgtacgtactttacgg

SEQ ID NO: 398508 - DNA, 535 bp, Homo sapiens
  misc_feature: GZ8MTXP02H7VKN.38.4.A04.1.454.CMB.2.raw
  modified_base (285)..(285): a, c, t, g, unknown or other
  modified_base (297)..(297): a, c, t, g, unknown or other
  modified_base (442)..(442): a, c, t, g, unknown or other
  modified_base (474)..(474): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaggtgtccagtgtgaggtgcaactggtggagtcgtgggggaggcttggtccaggccgggggggtccctggagactctcctgtgcagcctctgcattcaccttagtaactatttaangagctgggtccncagcctccgagggagggctggagtgggtgccagcattaaaccaagatggaaccgtagaaaaatctatgtaggactctggtagaaaggggccgaattcgcctagtcctccagacgacaacgccaaagaactcactgtgactgacanatagaacgctgagaggcgacgacacggctgtnttactcgtgtcgcggacgaccgcccccaagtcggaaggctacgaggtggacgctacgtacg

SEQ ID NO: 398509 - DNA, 539 bp, Homo sapiens
  misc_feature: GZ8MTXP02HCITP.38.4.A04.1.454.CMB.2.raw
  modified_base (370)..(370): a, c, t, g, unknown or other
  modified_base (402)..(402): a, c, t, g, unknown or other
  modified_base (418)..(418): a, c, t, g, unknown or other
  modified_base (431)..(431): a, c, t, g, unknown or other
  modified_base (441)..(441): a, c, t, g, unknown or other
  modified_base (445)..(445): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactattaatgagctgggtccgccagcctccgaggggaggggctggagtgggtggcccagcattaaccaagatggaccgtagaaaaatctatgnggactgtgtgaagggccattcgcatctcaganacaacgccaaagactnactgtgctgcacntagacggccngagnggcgacgacacggctgtcgtacttcgtgtcgacgacgaccgcccccagttacggaacgggtctaacgagggtacgggacgtacgtaacgtaccg

SEQ ID NO: 398510 - DNA, 539 bp, Homo sapiens
  misc_feature: GZ8MTXP02HB9Q3.38.4.A04.1.454.CMB.2.raw
  modified_base (298)..(298): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactattaatgagctgggtccnccagcctccgagggaaggggctggagtggggtggccagcattaaaccaagatggaaccgtagaaaaatctatgtggactctgtagaaagggcccgattcgcctatctccagagacaacgcccaaagaactcactgtgctgcacatagaacgcctagagaggcgacgacgtacggctgtgtactcgtgtcgcgacgacgcccccaagcggaaggctaacgacggtagggacgcgtacgtacg

SEQ ID NO: 398511 - DNA, 580 bp, Homo sapiens
  misc_feature: GZ8MTXP02FJ1ZU.38.4.A04.1.454.CMB.2.raw
  modified_base (308)..(308): a, c, t, g, unknown or other
  modified_base (340)..(340): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgagggccgggggggtccctggagactctcctgtgcagcctctgcattcctacctttagtaacttatttaatgagcgtgggtccnccagcctccgaggggaggggctggaggtgggngccagcaacttaaaccaagatggaacgtaagaaaaaatctaagtggtaggtactcgtaggtaggaacggggcctaagttccgcctactctaccgagacgaacaacgaccaaacgaactcactgtcgctgcacagtaggaaccggcctagagacggcgacgacgacggctgtcgtacttctggtcgcgacgacccgcccccagtggacggggactacggaggtgggaacgcgttaaaccgg

SEQ ID NO: 398512 - DNA, 597 bp, Homo sapiens
  misc_feature: GZ8MTXP02IN110.38.4.A04.1.454.CMB.2.raw
  modified_base (459)..(459): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccgattcgcatctcagagacaacgccaagactcactgtggctgcacatgaacggcctgagaggcgacgacacggctgtgtacttctgtgcgagacgccccccatggacgggctacgaggtggggagctacgtactttgactacgtggggccagggaccctggcaccgtctcctcacgccctccaaccacgggcccacgtccgttcccttcccccncggccacccctcctacccaagcgaccaccgtcggtcgggggccacgacggccggcccgtggggcctcggacccttcgggtaccgaaacggtaccttaacccgttccgacggttcgaactccggaccgttggaccgggg

SEQ ID NO: 398513 - DNA, 579 bp, Homo sapiens
  misc_feature: GZ8MTXP02I0Z6P.38.4.A04.1.454.CMB.2.raw
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaatctatgtggactctgtgaagggccattcgccatctccagagacaacgcaagactcactgtggctgcacatgaacggcctgagaggcgacgacacggctgtgtacttctgtgcgagacgccccccatggagggctacgaggtggggancgtacgactttgactacgtgggggccagggaaccctggtccaccgtctcctcacgccctccaccgaacgggcccagtccggtcccttcccccgtcggccaccccctcctacccgaaacgacgccaccgtcggtcgggggccacgacggccggcccgtggctcgccgtcggtacaacggactcgttccgacgtcgacgtcgactggacgg

SEQ ID NO: 398514 - DNA, 539 bp, Homo sapiens
  misc_feature: GZ8MTXP02IEBJH.38.4.A04.1.454.CMB.2.raw
  modified_base (281)..(281): a, c, t, g, unknown or other
  modified_base (396)..(396): a, c, t, g, unknown or other
  modified_base (486)..(486): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttcctgttgctattttagagtgtccagtgtgagtgcaactggtggagtcgtgggggagcttggtccaggccggggggtccctgagactctcctgtgcagcctctgcatcacctttagaactatttaangagctggtccgcagcctcgaggaagggctggagtgggtgccagcattaaccaagatggacgtagaaaaatactatgtggactcgtgtaggaaagggcccgagttcgcccaattcncccaagacgaacaaaccgaccaaacgaactacaactgtggcctgcacatgaacggcctgagaggcgacgacgacgctgtcgtactttcgngtgacgacgacgcccccaagcggacgggactacgaggtgggacgactaaccgg

SEQ ID NO: 398515 - DNA, 586 bp, Homo sapiens
  misc_feature: GZ8MTXP02F1HUM.38.4.A04.1.454.CMB.2.raw
  modified_base (296)..(296): a, c, t, g, unknown or other
  modified_base (326)..(326): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtcagtgtgaggtgcaactggtggagtcgtgggggaggcttggtccaggtcggggggtccctgagactctcctgtgcagcctctgcattcacctttagtaactatttaatgagctgggtccncagcctccgaggggaagggctggagtgggnggccagcataacaagatggaccgtagaaaaatctatgtaggactcgtgtaggaaaggggcctagttccgccagtcctccgaagacgaacaacgaccaaagaacctcacgtgacgctgcaacagtacgaacgggcctaggaacggacgggacgaaccgaccgacgggcctggttacgttacttcgtggtcgacggtacgaccgtacccccagtcgggaacgggtccaacgacggggtggggaccacggttaacgttaccgg

SEQ ID NO: 398516 - DNA, 563 bp, Homo sapiens
  misc_feature: GZ8MTXP02I58BF.38.4.A04.1.454.CMB.2.raw
  modified_base (287)..(287): a, c, t, g, unknown or other
  modified_base (300)..(300): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggcccggggggtccctggagactctcctgtgcagcctctgcattcaccttagtaactatttaangagcgtgggtccnccagcctccgagggaggggctggagtgggtgccagcataaccagataggacctagaaaatctatgtggactcgtgtaggaagggccagttcgcctatcctccagacgaacaacgccaaagacctcactgtcgctgacacagtacgaaccgggcctaggaggacggacgaacgtacgacggctcggtgtacttcgtggtcgacggacgacccgcccccgaacgtcggaacgggtctacggaggtcgggacgtacgtacgttacg

SEQ ID NO: 398517 - DNA, 699 bp, Homo sapiens
  misc_feature: GZ8MTXP02G50J2.38.4.A04.1.454.CMB.2.raw
  modified_base (318)..(318): a, c, t, g, unknown or other
  modified_base (660)..(660): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtcggtgggggaggtcgttgggtccgagggcccggggggggttccctggacgaccttctccgtgtgcagcctctgctattcacctttagtaactattatgagcgtgggtcccncacgcctcgaaggggaggggctggagggtggggcacgagtactaaccgtaaacgagtaggagtaacgtaaaataaactatagtcggtacgtctcggttaggaacgggaccggacttccgtacgacgtacctcgaacgaggaaacccgaactaacccgaaacgtaaactaccctacgtaacggttggcgtccgaacgacccgtttaaagacggtaacccggggacccgttagggaaacgggaacggaccgggacggaaacccggggtaccgtagtttcgtaccgtttaccgtgggtacgaccggacggaaccgcccccccgtacgttggaaacggccgttaanacggggttacgggacgttacaccggtttaagtttcccgg

SEQ ID NO: 398518 - DNA, 644 bp, Homo sapiens
  misc_feature: GZ8MTXP02GDKSP.38.4.A04.1.454.CMB.2.raw
  modified_base (300)..(300): a, c, t, g, unknown or other
  modified_base (314)..(314): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcgttgggtccgagggcccgggggggtccctggacgactctcctgtgcagcctctgctattcaacctttagtaaacttatttaangagtctcgggtccnccagccctacgaggggagggctggaggtgggtcgccagactaagttaaaccgaagacgtaggaccgtaagaaaaatctagtggtcgacttcgtagggtaggaaacggggtccctagttccgacctattcccgtaccgaaacgaacgaaaccgaaaccgacccgaaacgaaacctcaacgtcggtacgcgagaccaagacgtacggaacgccgtaggacgacggacgacgaacgcggtacgtgtacgttacgtcgtcggtcgaccgacgaccgacccccgagtacgggaacggtacgtacggaggtacggacgtaccgtacgtttaaccgg

SEQ ID NO: 398519 - DNA, 642 bp, Homo sapiens
  misc_feature: GZ8MTXP02HDUNQ.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccgaggcccgggggggtccctggagactctcctgtgcagcctctgcattcacctttagtaactattaatgagcgtcgggtccgccagccctaccggaggggaacggggctggggaggttggggttcgcccgaggctaacttaaaaccgaagacgtagggaaccgtaagaaaaaattctaagttaggtacggacttcgtggtaggaaacggggcccgtaagtttccgacctatccctacccgaaagaacgaaccgaaaccgacccgaaaacgaacctacaacgtggtcggctagcactagtagaacggttcgagaggacggacgaacgtacgacggcgtagtcgttacttcgtggtcgcggaacgaccgcccccgagtcggaacggcgtaaccgaggtacgggacgtaccgtaacggttacg

SEQ ID NO: 398520 - DNA, 551 bp, Homo sapiens
  misc_feature: GZ8MTXP02JMZ0J.38.4.A04.1.454.CMB.2.raw
  modified_base (301)..(301): a, c, t, g, unknown or other
  modified_base (324)..(324): a, c, t, g, unknown or other
  modified_base (331)..(331): a, c, t, g, unknown or other
  modified_base (400)..(400): a, c, t, g, unknown or other
  modified_base (482)..(482): a, c, t, g, unknown or other
  modified_base (488)..(488): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccgaggccgggggggtccctggagactctcctgtgcagcctctgcattcacctttagtaactattaatgagctgggtccnccagcctccgagggagggctggngtgggtnccagcataaaccagatggaaccgtagaaaaatctatgtggactcgtgtgaaggggccattccgcatccncaagacacaacgccaaagacctacactggtcggcttgcaacagtaggaaccggtctagaggaggacgacgacgacggctgtntacttntggtcgacgacgaccgacccccagtacggaacgggctacgaggtacggactcgtacgttaacg

SEQ ID NO: 398521 - DNA, 545 bp, Homo sapiens
  misc_feature: GZ8MTXP02HCO9R.38.4.A04.1.454.CMB.2.raw
  modified_base (361)..(361): a, c, t, g, unknown or other
  modified_base (441)..(441): a, c, t, g, unknown or other
  modified_base (448)..(448): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttcctgtagctatttagaaggtgtccagtgtgaggtgcaactggtggagtctgggggagcttgggtccaggccggggggtccctggagactctcctgtgcagcctctgcattcacctttagtaactatttaatgagctgggtccgccagcctccgaggggaacggggctcggagtggggtggcccgagcattaaccaagactggaccgtanaaaaggggtactatagtggactctgtggaaggccgattcggcccattcgccagagacaacgccaaagactacaactgggngctgcanacgagacgcgagagaggacgacgacgacgcgtgtcgtactcgtgtcgacgacgaccgcccgagcgaacggcgacgacggaggacgtacgtacgtacg

SEQ ID NO: 398522 - DNA, 539 bp, Homo sapiens
  misc_feature: GZ8MTXP02HX4MV.38.4.A04.1.454.CMB.2.raw
  modified_base (287)..(287): a, c, t, g, unknown or other
  modified_base (296)..(296): a, c, t, g, unknown or other
  modified_base (326)..(326): a, c, t, g, unknown or other
  modified_base (364)..(364): a, c, t, g, unknown or other
  modified_base (369)..(369): a, c, t, g, unknown or other
  modified_base (385)..(385): a, c, t, g, unknown or other
  modified_base (420)..(420): a, c, t, g, unknown or other
  modified_base (424)..(424): a, c, t, g, unknown or other
  modified_base (430)..(430): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtctgggggaggcttggtccaggccgggggggtccagagactctctgtgcagcctctgcattcacctttagtaactattaatganctgggtccnccagccctccgagggaaggctggagtgggngccagcataaaccagatggaccgtagaaaaatctatgngactntgtgaaggcatcgcanctcaagacgacaaacgccaaagtaactcaactggngctnacacanagacgacgagagaggacgacgacgacgcgtcgtacgtacgtcgtcgtcgacgacgaccgaccccgaccgacggaacggacgtacgacggacggacggtacgtacgtacg

SEQ ID NO: 398523 - DNA, 585 bp, Homo sapiens
  misc_feature: GZ8MTXP02JRUPV.38.4.A04.1.454.CMB.2.raw
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgccatctccagagacaacgcaagaactcactgtggctgcacatcgaacggcctggagaggcgacgacacggctgtgtacttcgtgtgacgagacgcccccatgaggtctacgaggtgganctacgactttgactacgtggggccagggaaccctggtccaccgtctcctcacgccctccaccgacgggccccagtccggtccttcccccgtggcccaccccgtccctacccgaacgacgccacccgtcgcgggggcaacgcggccggcccgtggggcctcggacccgttggaccgaacggacctaacgttccgaacgtcgacgtcgacgtcgacgg

SEQ ID NO: 398524 - DNA, 700 bp, Homo sapiens
  misc_feature: GZ8MTXP02IUT0M.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaatctatgtgactctgtgaagggccattcgccatctcagagacacgcaagaactcactgtggctgcacatgaacggcctgagaggcgacgacacggctgtgttacttcgtgtcgacgagaccgccccccagtcggacgggtctaacggaggtacggggacgtccgttaacggttactttacggaccttaccggggtcgggggacccgtaacgggggtaaaccccgttcgggtacccgtacccggtccttcccgttaccgacggtccccctacccgaaacccggaaaccggggtacccctacgttcccgggtttcccctttcccccgtcggtacccctaccccccttccgaaccccaaacggccgaccctaccgttcggcgggggaccaacgcggtcccggcccgttggggcctcggccgttacggtaccgaacggtacctttaaccgtccgtacggttcgacgttcggacgttggaccgg

SEQ ID NO: 398525 - DNA, 578 bp, Homo sapiens
  misc_feature: GZ8MTXP02IKPNH.38.4.A04.1.454.CMB.2.raw
  modified_base (360)..(360): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaatctatgtggactctgtgaaggccgattcgccatctcagagacaacgcaagactcactgtgctgcacatgaacgctgagaggcacgacacggctgtcgtacttcgtgtgcgagaccgcccccagtgaggctacgaggtgggancgtacgtactttgacttacgtggggaccaagggaccctggccaccgtctccctcgacgccctaccaccgaacgggcccacgtccggttcccttccccgtcggccctacccctcctacccaacgacgccacccgtcggcggggacacgacgcccggccgtcgggctcgccgtcgaccaaacggctaaccgtccgaacgtcacgttccgacgtacggcgg

SEQ ID NO: 398526 - DNA, 521 bp, Homo sapiens
  misc_feature: GZ8MTXP02JAM34.38.4.A04.1.454.CMB.2.raw
  modified_base (285)..(285): a, c, t, g, unknown or other
  modified_base (297)..(297): a, c, t, g, unknown or other
  modified_base (325)..(325): a, c, t, g, unknown or other
  modified_base (442)..(442): a, c, t, g, unknown or other
  modified_base (511)..(511): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttggtccaggccgggggggtccctgagactctcctgtgcagcctctgcattcacctttagtaactattaangagctgggtccnccagcctcgagggagggctggagtgggngccagcattaaccagatggaccgtagaaaaatctatgtggactcgtgtgaagggccgattcgccatctcagagacaacgccaaagacctcactgtgctgcacatgaacggcctgagnggcgacgacacggctggtcgtacttcgtgtcgcgacgacgcccccagtcggaaggcacgaggtgggacncgtacgtacg

SEQ ID NO: 398527 - DNA, 688 bp, Homo sapiens
  misc_feature: GZ8MTXP02G5GJD.38.4.A04.1.454.CMB.2.raw
  modified_base (301)..(301): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggccggggggtccctgagactctcctgtgcagcctctgctattcacctttagtaacttatttaatgagcgtgggtcccnccagccctccgaggggaggggctggagtggggtggcccagcaattaaaccgaagagtaggaaccgtagaaaaatctagtgtaggactcgtggtaggaaacggggtccgtaagttccggcctaacgttcctaccgaacgaacgaaaccgaaaccgacccgaaaacgtaaaccctaccgtaaccgttagggtacggccgttacggaccaaaccgtaagtacggaaacccgggcccgtaggaacgggacgggaccggaaccggaacgaccgggtaccgtggttacgttaccgttcgttggtacggaccggaacggacccgccccccgaagtacgggaacgggtaccgtaccggtaggggtacggggacggtaccgttaacggtttaaccg

SEQ ID NO: 398528 - DNA, 549 bp, Homo sapiens
  misc_feature: GZ8MTXP02I2Y49.38.4.A04.1.454.CMB.2.raw
  modified_base (386)..(386): a, c, t, g, unknown or other
  modified_base (419)..(419): a, c, t, g, unknown or other
  modified_base (430)..(430): a, c, t, g, unknown or other
  modified_base (435)..(435): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaaactattaatgagcgtgggtccgccagcctccgaggggaagggctggaggtggggtggcccagcaattaaaccaagatggaccgtagaaaaatctaatgtggactcgtgnggaaagggccgattcgcatcctcagagacaacnccaaagacctnactgngctgcacagtagaacgcctagagaggcgacgacgacggctgtgttacttcgtggtcgcggaacgcgacccccagtcgggaacggctaacgacgggtgggactcgtacgttaacg

SEQ ID NO: 398529 - DNA, 582 bp, Homo sapiens
  misc_feature: GZ8MTXP02GVHSK.38.4.A04.1.454.CMB.2.raw
  modified_base (332)..(332): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaaatctatgtggactctgtgaagggccgattcgccatctccagagacaacgccaaagaactcactgtggctgcacatgaacggcctgagaggcgacgcacggctgtgtacttcngtgcgagacgcccccagtgagggctacgaggtggganctacgactttgactacgtgggggccagggaaccctggtccaccgtcgtccctcacgccctccaaccgaacgggcccagtccgggtcccttcccccgtcggccacccctcctacccaacgaccgcaccgtcgtgggggcacgacggccggcccgtggggcctcggccgtcggtacaacgggactaacgttccacgttcgacgtcgactggacgg

SEQ ID NO: 398530 - DNA, 599 bp, Homo sapiens
  misc_feature: GZ8MTXP02FVG79.38.4.A04.1.454.CMB.2.raw
  modified_base (269)..(269): a, c, t, g, unknown or other
  modified_base (308)..(308): a, c, t, g, unknown or other
  modified_base (343)..(343): a, c, t, g, unknown or other
  modified_base (508)..(508): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcgttggtccgagggcccgggggggtccctggacgacctctcctgtgcagcctngcattcacctttagtaacttatttaatgagctgggtccnccagccctccgaggggaaggggctggagtgggttncccagctaattaaccaagataggaccgtaagaaaaatactagtgtaggactcgtggtagaaacggggcctattcgacctatcctacccgagaagaaccaacggaccaaagaacctcactgtgctgacacatcgaacgctgacgaggcgacgacgacggtctggtnttaccgttgtcgtggccgacgacccgacccccctagtcggaacggggtacccttaacggacggtaggggactccgttaacggtttaaccgg

SEQ ID NO: 398531 - DNA, 560 bp, Homo sapiens
  misc_feature: GZ8MTXP02HO5L6.38.4.A04.1.454.CMB.2.raw
  modified_base (303)..(303): a, c, t, g, unknown or other
  modified_base (459)..(459): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcttggtccaggcccgggggggtccctggagactctcctgtgcagcctctgcattcacctttagtaactatttaatgagctgggtccnccagcctccgaggggaaggggctggagtgggtggccagcattaaccaagatggaccgtagaaaaaatctaagtgtaggactcgtgtaggaaacgggccgtaatttccgcctaatcctacccaagacgaacaacgccaaagactcactgtgctgcanatgaacgctgagaggcgacgacacggctgtgtacttcgtgtcgacggacaccgcccccagtggaacgggctacgagggtacgggacgtaccgttacgtacg

SEQ ID NO: 398532 - DNA, 547 bp, Homo sapiens
  misc_feature: GZ8MTXP02HSFB1.38.4.A04.1.454.CMB.2.raw
  modified_base (253)..(253): a, c, t, g, unknown or other
  modified_base (356)..(356): a, c, t, g, unknown or other
  modified_base (361)..(361): a, c, t, g, unknown or other
  modified_base (379)..(379): a, c, t, g, unknown or other
  modified_base (408)..(408): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcaccttttagtaactatttaatgagctgggtccgccagcctccagggaagggctggagtgggtgccagcattaaccaagatggacgtagaaaaatctatgtggactctgtgaaggccattcgccatcncagagacaacgccaagaactcactgtgctgcacatgaacgctgagaggcacgacacggctgtcgtacttcgtgtgcgagcgcccccatggacggctacgaggnggganctacgatttgacttacgnggggccagggaaccctggtcaccgtctcncacgcctccacaacggccagtcgtccttccccgtggccaccctcctaccaagcgaccaccgtcgcggggaccacgaggtccgcccgtgggcctggaccgtcggtacaacggctaaccgttcacgtgactcgactgacgg

SEQ ID NO: 398533 - DNA, 525 bp, Homo sapiens
  misc_feature: GZ8MTXP02GXLEQ.38.4.A04.1.454.CMB.2.raw
  modified_base (295)..(295): a, c, t, g, unknown or other
  modified_base (409)..(409): a, c, t, g, unknown or other
  modified_base (418)..(418): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggccggggggtcctgagactctcctgtgcagcctctgcattcacctttagtaactattaatgagctgggtccncagcctcgagggaggctggagtggtgccagcataacagatggacgtagaaaatctatgtgactctgagaacgggcattcgcatctaccagacgacaacgcaaagacctcactgngctgcaacngtacgaacggcagacgaggcgacgacgacggctgtcgtacttcgtgcggacgacgacccgacccccagtcggaacgggactacggaggtgggacgtccgtacgtacg

SEQ ID NO: 398534 - DNA, 535 bp, Homo sapiens
  misc_feature: GZ8MTXP02H3ZBN.38.4.A04.1.454.CMB.2.raw
  modified_base (298)..(298): a, c, t, g, unknown or other
  modified_base (365)..(365): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattgggctgagctgggtttccttgtgctatttagaaggtgtccagtgtgaggtgcaactgggtggagtcgtgggggaggcttggtccaggccggggggtccctgagactctcctgtgcagcctctgctattcacctttagtaacttatttaatgagcgtgggtccnccagccctcgagggagggctggagtgggtcgccagcataaccaagatggacctagaaaaatctatgnggactgtgtgaacgggcctattcgctatctcagacgacaacgcaaagacctcactgtgctgcacatgaacgctgagaggcgacgacacggctggtacgtacttcgtggtcgcgaacgaccgacccccagtacggaacggactaacggacggtggacgtcgttaacgtacg

SEQ ID NO: 398535 - DNA, 589 bp, Homo sapiens
  misc_feature: GZ8MTXP02JOFTN.38.4.A04.1.454.CMB.2.raw
  modified_base (307)..(307): a, c, t, g, unknown or other
  modified_base (331)..(331): a, c, t, g, unknown or other
  modified_base (358)..(358): a, c, t, g, unknown or other
  modified_base (366)..(366): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagactcactgtggctgcacatgaacggcctgagnggcacgacacggctgtgtacttcngtgcgagacgcccccatgagggctacnggtggganctaacggactttggactacgtgggggccagggaaccctggtccaccgtctccctcacgccctccaccgaacgggcccatccggtccttcccccgtcggcccacccctccctcccaacgacgccacctcgtcgggggccacgacgccggcccgtcggcgtcggcccgtcggtaccgaacggtacctaaccgttacccgacggtcgacgtcgaccgtaggacggg

SEQ ID NO: 398536 - DNA, 605 bp, Homo sapiens
  misc_feature: GZ8MTXP02HGY52.38.4.A04.1.454.CMB.2.raw
  modified_base (285)..(285): a, c, t, g, unknown or other
  modified_base (297)..(297): a, c, t, g, unknown or other
  modified_base (326)..(326): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccaggccggggggtcctgagactctcctgtgcagcctctgcattcacctttagtaactattaangagctgggtccnccagcctcgaggggagggctggagtgggngccagcataaaccagatggacgtagaaaaatctatgtggactcgtagtaggaaacggggccgtagttccgacctatcctaccagaacgaacaaccggaccaaagaacctcactgtcggactgacaacgagttacgaaaccggcctaggacggacgggaccgacggacgacggtctggtacgttaccgttcgtggttacggcggaacgacccgaccccccgtagttacgggaacgggtaccttaacgaggggtacgggacggtaccgtaacggtttaccg

SEQ ID NO: 398537 - DNA, 537 bp, Homo sapiens
  misc_feature: GZ8MTXP02F5XL2.38.4.A04.1.454.CMB.2.raw
  modified_base (297)..(297): a, c, t, g, unknown or other
  modified_base (445)..(445): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttggtccaggccgggggggtccctgagactctcctgtgcagcctctgcattcacctttagtaactattaatgagctgggtccncagcctccgagggagggctggagtggggtgccagcataaccagatggaccgtagaaaaatctatgtggactctgtgaagggccattcgccatctccagacgacaacgcaaagaactcacgtgtcgctgcacatggaacggcctgaagnggacgacgactacggctgtgtacttctggtgacgagaccgcccccagtacggaagggtaccctacgacggggagggacgtaccgtacgtacg

SEQ ID NO: 398538 - DNA, 580 bp, Homo sapiens
  misc_feature: GZ8MTXP02JF92Y.38.4.A04.1.454.CMB.2.raw
  modified_base (388)..(388): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtagggacagagtcaccatcacttgccgggccagtcagggcattaggactcgtttagcctggtatcagacaaaaaccagggaaacgccccctaaactcctgatctatggtgcatccattttgactaaaaggttcggggtaccccagttcgaaaggtttccaaggcggccagtggatcgtaggggacaggtattcgaagtctacanaatcagcagccctgcagtcctaggacgatactgacctaatttattattgtctacagtctttaaatacgttaccccattacgtttacggcccgaaggggtacctaaggtttacgggaagtactacgtaaaacggaccgttaggtacgcgttaggaaccgtacctaattctacggttccttactactttccccg

SEQ ID NO: 398539 - DNA, 600 bp, Homo sapiens
  misc_feature: GZ8MTXP02GW2WM.38.4.A04.1.454.CMB.2.raw
  modified_base (260)..(260): a, c, t, g, unknown or other
  modified_base (285)..(285): a, c, t, g, unknown or other
  modified_base (297)..(297): a, c, t, g, unknown or other
tcagtcgatcacgtcacgaccggtgctcgatttagagtagtgatcaggggttctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctggagactctcctgtgcagcctntgcattcacctttagaactattaangagctgggtccncagcctcgaggggaagggctggaggtgggtcggccaggctaattaaaccaagatggaaccgtagaaaaatactagtggtaggactcgtggtaggaaacgggggccctaagttccgacctagtcctacccaagacgaacaaacgaccaaaacgaacctacacgtgtcggctagacaacagtacggaaaccggtccgtaggaacgaggggaccgaacgacgtaacggcgtgtacgtacttcgtgtacggacgaacgaccgaccccccagtcggaacgggctaacgaggtgggacgcgtacgtacg

SEQ ID NO: 398540 - DNA, 629 bp, Homo sapiens
  misc_feature: GZ8MTXP02JKIWC.38.4.A04.1.454.CMB.2.raw
  modified_base (565)..(565): a, c, t, g, unknown or other
tcagtcgatcacgtcacgaccggtgctcgatttagagtagtgatcagggggtctacagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagtcgttggtccgaggccggggggtcctgagactctcctgtgcagcctctgctattcgaacctttagtaacttattaatgagtccgtcgggtccaccagcctcggagggaggggctggaggtgggtgccagcactaaaccagataggaaccgtaagaaaatcgtaagtggtagacttcgtaggtacgggaagggtacccgtaagttacccggaccaacttcccgtaccgaacggaacgaacccaacggaacccaaaaggtacctacgaacgttggacggctagcccaaagtacgtacggaaaccggcctaggaacgaggaccgaacgaccacggtctagtcgtacttcgnggtacgcgtacgacccgtcccccgagtggaaccggtactacgagggtcggactcgtacgttacg

SEQ ID NO: 398541 - DNA, 540 bp, Homo sapiens
  misc_feature: GZ8MTXP02F014V.38.4.A04.1.454.CMB.2.raw
  modified_base (289)..(289): a, c, t, g, unknown or other
  modified_base (301)..(301): a, c, t, g, unknown or other
  modified_base (434)..(434): a, c, t, g, unknown or other
tcagtcgatcacgtcacgaccggtgctcgatttagagtagtgatcaggggaggtctcagagaggagccttatccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctggagactctcctgtgcagcctctgcattcacctttagtaactatttaangagctgggtccnccagcctccgaggggaaggggctgggaggtgggtggccaggcaataaccaagatgggacgtagaaaaatctatgtggactctgtggaagggccgattccgcatctccagagacaacgaccaagaactcactgngctgcacatagaacggctagaggaggacgacgacacggctgtcgtacttctggtgcgacgaccgcccccagtggacgggctacggaggtcgggacgcgttaaccgg

SEQ ID NO: 398542 - DNA, 549 bp, Homo sapiens
  misc_feature: GZ8MTXP02GI5JB.38.4.A04.1.454.CMB.2.raw
  modified_base (301)..(301): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggagcttgggtccaggccgggggggtccctggagactctcctgtgcagcctctgcattcacctttagaacttatttaatgagctgggtccnccagcctcgaggggagggctggagtgggtggccagcattaaccaagatggaccgtagaaaatactatgtgactcgtgtggaagggccgattcgacctatcctaccagagacaacgaccaaagactacactgtgctgcacagtgaacggccgtagaacggaggacgacgacgacggctgtgtacttcgtgtcgcgacgaccgcccccagtcggaacgggtctacgacggtgggacgtccgtacgttacg

SEQ ID NO: 398543 - DNA, 526 bp, Homo sapiens
  misc_feature: GZ8MTXP02FV86H.38.4.A04.1.454.CMB.2.raw
  modified_base (297)..(297): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactattaatgagctgggtccnccagcctccgagggaggggctggagtggggtgccagcataaccaagatggaccgtagaaaaatctatgtggactctgtgagggccgattcgccatctccagagacaacgccaagactcactgtggctgcacatcgaacggcctggacgagggcgacgacgacggctagtgtacttctgtcgcgagccgcccccagtcgaagggctacgcggtggacgcgtacgttaacg

SEQ ID NO: 398544 - DNA, 578 bp, Homo sapiens
  misc_feature: GZ8MTXP02HVSUV.38.4.A04.1.454.CMB.2.raw
  modified_base (304)..(304): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcttggtccgaggcccggggggtccctggagactctcctgtgcagcctctgctattcacctttagtaacttattaatgagcgtgggtcccnccagccctccgaggggaagggctggagtgggtgccagcaattaaccagatggactagaaaaatctatgtggactgtgtgaagggccctattcgactatcctaccagagacaacgaccaaagactcactgtgctgacaacagtacgaaccggcgtaggagacggaccgaacggacgacggctcgtcgttacttcgtggtcgacggaacgcccgacccccgtagtacgggaacgggtccctaaggtacgggtagggaccgtacgtacgtttaaccg

SEQ ID NO: 398545 - DNA, 594 bp, Homo sapiens
  misc_feature: GZ8MTXP02H5L51.38.4.A04.1.454.CMB.2.raw
  modified_base (309)..(309): a, c, t, g, unknown or other
  modified_base (359)..(359): a, c, t, g, unknown or other
tcagtcgatcacgtcacgaccggtgctcgatttagagtagtgatcagggggtctcagagaggagccttagcccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcgttgggtccgagggccgggggggtccctggagactctcctgtgcagcctctgcattcacctttagtaaactatttaatgagcgtgggtccnccagccctccgaggggaggggctgggagtgggtgccagcataaccaaganggaccgtaagaaaaatcattgtaggactctggtagaacggccgtattcgcctatcctacagacgaccaaacgccaaagaactcaactgtcgactgaccacaatggaaacggcctaggagacgggacgaacggacacggtctgtcgttacttactcggtgccgaacgacccgacccccagtacgggaacgggtactaacggtagggtacgggacggtaccgttaacggttaaccgg

SEQ ID NO: 398546 - DNA, 557 bp, Homo sapiens
  misc_feature: GZ8MTXP02IIEBH.38.4.A04.1.454.CMB.2.raw
  modified_base (260)..(260): a, c, t, g, unknown or other
  modified_base (266)..(266): a, c, t, g, unknown or other
  modified_base (289)..(289): a, c, t, g, unknown or other
  modified_base (367)..(367): a, c, t, g, unknown or other
  modified_base (394)..(394): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggccagtcagggcattaggactcgttagcctggtatcagacaaaaacnggaacncccctaactcctgatctatggtncatcctattttgactaaaggtgggtcccatcaaggttcaggcgcagtgatctgggacagattcagtctcactaatcancagccctgacagccgtgggatactacngacctaatttacgttaactgtacaaacgtagtactttaaatagttactcgttactacgtttcggggacgggtaacggaccctaaaaggggttccaaagggcttaaaccggaaaagtaccgtgttacgggcctaaggaccacacttcctacggttctactaacc

SEQ ID NO: 398547 - DNA, 600 bp, Homo sapiens
  misc_feature: GZ8MTXP02J0GM3.38.4.A04.1.454.CMB.2.raw
  modified_base (275)..(275): a, c, t, g, unknown or other
  modified_base (298)..(298): a, c, t, g, unknown or other
  modified_base (379)..(379): a, c, t, g, unknown or other
  modified_base (419)..(419): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggccagtcagggcagttaggacttcgtttagccttggtatcagacaaaaaccgagggaaacncccctaactcctgatctatggtncatcctattttcgactaaaggtcgggtacccagtacaaggttcagcggaccaggtgatcgtagggacagtatcgagtctanacaatcagccaggcctgacagtcctagggacataccgtanactaatttattacgttacgtactaacgtataacctttaaacgtacccgttacccctaagtttaccggtttacggacccggtaacggggtaactaaggttacggaactaaagtaaacgaaaacgtacgtacgtacggtactacggaacctaacgtacttcgttacgtcttactaccttcccg

SEQ ID NO: 398548 - DNA, 549 bp, Homo sapiens
  misc_feature: GZ8MTXP02FTGQB.38.4.A04.1.454.CMB.2.raw
  modified_base (301)..(301): a, c, t, g, unknown or other
  modified_base (331)..(331): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctggagactctcctgtgcagcctctgcattcacctttagaactatttaatgagctggggtcccnccagcctcgagggaggggctggagtgggtnccagcattaaccagatggaccgtagaaaaatactatgtggactcgtgtagagggccattcgaccatctccagagaacacgccaagactcactgtagctgcacagtgaacggtctaggagaggcgacgacgacggctgtcgttacttcgtggtcgcggacgacccgccccccagtcgggaacggggcctaacgacgggtaggggagaccgtacggtacg

SEQ ID NO: 398549 - DNA, 677 bp, Homo sapiens
  misc_feature: GZ8MTXP02HN2MV.38.4.A04.1.454.CMB.2.raw
  modified_base (238)..(238): a, c, t, g, unknown or other
  modified_base (260)..(260): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaaatactatgtggactntgtgaagggccattcgccatcnccagagacaacgcaagaactcactgtgctgcacatgaacggcctggagaggcgacgacgacggctggtgtacttctgtgcgagccgcccccagtcgagggcacgaggtgggacgcgtaacgtctttgaccgttaacggtcgggggccgaacggggtaacccgtggtacccgtacccgttcctcccgttccgaccgtccccgtacccaacccgaacgggccccctacgttcccggttccccctttcccccgtcgggtccccacccctttcccgacccaaacggccgccgtaacccttccgggacgggggccaaccgaccgggccgggtccccgtggggcccgtcggacccgttgggaccgtaacgggtaaccttaacccgttccgaacggttcgacgttaccggaacgttcggcgggg

SEQ ID NO: 398550 - DNA, 526 bp, Homo sapiens
  misc_feature: GZ8MTXP02JFDXS.38.4.A04.1.454.CMB.2.raw
  modified_base (297)..(297): a, c, t, g, unknown or other
  modified_base (327)..(327): a, c, t, g, unknown or other
  modified_base (376)..(376): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactattaatgagctgggtccnccagcctccgaggggagggctggagtgggnggccagcaattaaccaagatggaccgtagaaaaatctatgtgactctgnggaagggccattcgcatctcagacgacaacgccaaagactcactgtgctgcacagtgaacggctgagaggcgacgacgacggctgtgtacttcgtgtcgcgacgaccgcccccagtcggaacggctacgacggtggacgcgtacgttacg

SEQ ID NO: 398551 - DNA, 543 bp, Homo sapiens
  misc_feature: GZ8MTXP02G18TI.38.4.A04.1.454.CMB.2.raw
  modified_base (302)..(302): a, c, t, g, unknown or other
  modified_base (493)..(493): a, c, t, g, unknown or other
  modified_base (533)..(533): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttggtccaggcccggggggggtccctggagactctcctgtgcagcctctgcattcacctttagtaactattaatgagctgggtccnccagccctccgaggggaaggggctggagtgggttgccagcattaaaccaagatggaccgtagaaaaaatctatgtggactcgtgtaggaaaggggccattccgactatctccagagacaacgccaaagactcaactgtacggctgcacatgaaacggtctagagaggacgacgacgacggctgtgtactgngtcgcgagaccgcccccatggaaggctacgaggtgggacncgtacgtacg

SEQ ID NO: 398552 - DNA, 574 bp, Homo sapiens
  misc_feature: GZ8MTXP02FPK73.38.4.A04.1.454.CMB.2.raw
  modified_base (308)..(308): a, c, t, g, unknown or other
  modified_base (333)..(333): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtagaaaaatactatgtggactctatgaagggccgattcgccatctccagagacaacgccaagaactcactgtggctgcacatgaacggcctgagnggcgacgacacggctgtgtacttcnggtgcgagacgcccccatgaggggctacnggtgggagctacgactttgactacgtgggggccagggaaccctggtccaccgtctcctcacgccctcaccgacgggcccatccggtcctccccctcggccacccctcctaccaacgcgcacctcgtgggggccacgacgccggcccgtgggcctcgccgtcggtaccaaggtacctaaccgttcccacgttcgacgtcggaccttggacggg

SEQ ID NO: 398553 - DNA, 601 bp, Homo sapiens
  misc_feature: GZ8MTXP02ION95.38.4.A04.1.454.CMB.2.raw
  modified_base (366)..(366): a, c, t, g, unknown or other
  modified_base (423)..(423): a, c, t, g, unknown or other
tcagtcgatcacgtcacgaccggtgctcgatttagagtagtgatcagggggaagaccgatgggcccttggggaggcttggtccagccggggggtccctgagactctcctgtgcagcctctgcattcacctttagtaactatttaatgagctgggtccgccagcctccgagggaaggggctggagtgggtggccagcattaaaccaagatggacgtagaaaaatactatgtggactctgtgaagggccattcgccatctcagagacaacgccaagaactcactgtggctgcacatgaacgctgagaggcgacgacacggctgtgtacttctgtgcgagacgccccccatgaggctacgagtgggganctacgactttgactacgtggggccagggaaccctggccaccgtctcctcacgtcccnccacgaacgggccctacgtccggttcccttcccccgtgggacccacccttccaccccaaagcgccaccgtcgcgggggccaacgcggccggccccgttggggccttcggaccctttgggtaccaaaacgggacttaaccttcccgacgggttaccaagtcccgaacgttggaaccggg

SEQ ID NO: 398554 - DNA, 600 bp, Homo sapiens
  misc_feature: GZ8MTXP02FT92S.38.4.A04.1.454.CMB.2.raw
  modified_base (312)..(312): a, c, t, g, unknown or other
  modified_base (328)..(328): a, c, t, g, unknown or other
  modified_base (338)..(338): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctcagggaagggctggagtgggtgccagcattaaccaagatggacgtgaaaaaatctaatgtggactctgtgaagggccgattcgccatctccagagacaacgccaagaactcactgtgctgcacatgaacgctgagaggcgacganacggctgtgtacttcngtgcgagacnccccatgaggctacgaggtggganctaacgctttgactcgtggggccaagggaaccctggtccaccgtcctcctcacgccctaccaaccgaaacgggccccagttcccgggtccttaccccccgtcggacctaccccctcctacccaaacgacgcctaacccgttcggacggggccacgacggtcccgggcccgtcggggctcggaccgttcgggtacgtaacggacctaaccgttccgaacgttcgactcgacgtgacggg

SEQ ID NO: 398555 - DNA, 565 bp, Homo sapiens
  misc_feature: GZ8MTXP02G6H27.38.4.A04.1.454.CMB.2.raw
  modified_base (305)..(305): a, c, t, g, unknown or other
  modified_base (418)..(418): a, c, t, g, unknown or other
  modified_base (447)..(447): a, c, t, g, unknown or other
  modified_base (450)..(451): a, c, t, g, unknown or other
  modified_base (454)..(454): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtgggttttccttgttgctattttagaaggtgtccagtgtgaggtgcaactggtggagtcgtgggggaggcttgggtccagggccgggggggtccctggagactcgtcctgtgcagcctctgcattcacctttagtaaactatttaatgagctgggtccnccagcctccgagggagggctggagtggggtgccaggcattaaaccaagatggaaccgtagaaaaaatctagtgtaggactctagtcggaaaggggcccgtattccgctatccnccagacgacaacgctaaagactcactggngcnncanagagacgacgagagaggacgacgacgacggcgtgtgtacgttcgtgtcggacgacgaccgaccccgaccgtacggaacggacgtacgtacggtacggacgacgtacgtacg

SEQ ID NO: 398556 - DNA, 728 bp, Homo sapiens
  misc_feature: GZ8MTXP02H6OLX.38.4.A04.1.454.CMB.2.raw
  modified_base (256)..(256): a, c, t, g, unknown or other
  modified_base (358)..(358): a, c, t, g, unknown or other
tcagtcgatcacgtcacgaccggtgctcgatttagagtagtgatcagggggaagaccgatgggcccttgggggaggcttggtccagccgggggggtcctgagactctcctgtgcagcctctgcattcaccttttagtaactatttaatgagctgggtccgccagcctccgaggggaaggggctggagtgggtggccagcattaaccaagatggacgtagaaaaatctatgtggactctgtgaaggcattcgcatcncagagacacgccaagactcactgtggctgcacatgaacggcctggagaggcgacgacacggctgtgtacttctgtgcgagcgcccccagtggagggctacgnggtaggggacgtcgtacgtactttgaacgttacgtcgggggaccaacggggtaaaccccgtgggtaccctacccggtcccttccctccgacggtacccctacccgaacccgaaaccggggccccctaacgttcccgggttcccctttccccccgtccgggtacccctacccccgttccctaccccgaaacgaccggtaccctaacccggttccggtcggggggacccacgaaccgggcccggggtacccccggtcgggggtccgtccgggtcccggttacgggtacccggtaaaacggggtaccctttaacccggtttacccgaacggttaccggtaacgtttacccggaacgtttacgggaaccggggg

SEQ ID NO: 398557 - DNA, 567 bp, Homo sapiens
  misc_feature: GZ8MTXP02ILZTB.38.4.A04.1.454.CMB.2.raw
  modified_base (290)..(290): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttaccgggcagtcagggcattaggactcgttagcctggtatcagacaaaaccaggaaacgcccctaacctcctgatctatggtncatcctattttgcaaaggtcgggtacccatcaaaggttcaggcggcagtggatcgtagggacaggtaattcgagtctcacaatcagcagcctgcagcctggagatactgactaaacttattaattgtactactacgtacttaactacgtaccccctaactaccgttttcggaccgtaggggtaacctaaggttacggaagtactaacgaaacgtaaacgtggtacggtacgtcgacctaacgtacttacttcgttacctactaacttcccttacccg

SEQ ID NO: 398558 - DNA, 542 bp, Homo sapiens
  misc_feature: GZ8MTXP02I5M9S.38.4.A04.1.454.CMB.2.raw
  modified_base (283)..(283): a, c, t, g, unknown or other
  modified_base (295)..(295): a, c, t, g, unknown or other
  modified_base (529)..(529): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttggtccaggccggggggtccctgagactctcctgtgcagcctctgcattcaccttagtaactattaangagctgggtccnccagcctccgagggaagggctggagtgggtgccagcataaccagatggacgtagaaaatctatgtggactcgtgtaggaagggccgtattcgccagtctcgagagacaacgccaaagactcaactgtgctagcacatgaaccgcgtacgagaggcggacgaacgaggctagtgtacttcgtggtcgcgacggacgccccctagtcggaacgggacctacgaggtcgggggaacncggtaacgtaacg

SEQ ID NO: 398559 - DNA, 637 bp, Homo sapiens
  misc_feature: GZ8MTXP02JICWV.38.4.A04.1.454.CMB.2.raw
  modified_base (275)..(275): a, c, t, g, unknown or other
  modified_base (299)..(299): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttggccgggcagtcagggctagttaggactcgttagcctggtactcgagaacaaaaacgagggaaacncccctaactcctagatctagtgtncatctatttgacgtaaaggtcgggtaccagtacgtaaggtcaggcgcctaggtggactcggtagggaacaaggtacttcgaacgttcctacaacgtaactcgaagccgaacgtcccgtagacgacggtccgtaggacgtaacttacgttacgaaaccttaatttaactttaagttacgtaacttaactaacgttacctttaaaacgtacccgttaaccccctagttaccggtttcgggaccgtaacgggggtaactaaggttaggaaactaacgtaaacgaaaacgtagtcgttacggctacgaaccacctactcttcgtactttaccgactttcccg

SEQ ID NO: 398560 - DNA, 670 bp, Homo sapiens
  misc_feature: GZ8MTXP02IQ5AE.38.4.A04.1.454.CMB.2.raw
  modified_base (299)..(299): a, c, t, g, unknown or other
  modified_base (363)..(363): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtgccagcattaaccaagatggacgtagaaaaatctatgtggactctgtgaagggccattcgcatctcagagacaacgcaagactcactgtgctgcacatgacggcctgagnggcgacgacacggctgtcgtacttctgtgcgagacgcccccagtcgaggctacgaggtcgggancgtacgtactttggaaccttacggtcgggggaccaaggggaaccccttgggaccctaccgtctcccgtacgacgtcccctaccaacccgaaacgggcccctacgttcccgggttcccctttcccccgtcgggcccctaacccccgttccctaaccccgaaagaccgacccgtacccgtccgggtacgggggacccacgacgggcccgggtccccgtgggggccctttacggcccgttacgggtaccgtaaacggtaccttaaccgtttacccgacggttacgacgttccggaacgttcggaccgggg

SEQ ID NO: 398561 - DNA, 605 bp, Homo sapiens
  misc_feature: GZ8MTXP02GDD0O.38.4.A04.1.454.CMB.2.raw
  modified_base (299)..(299): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttccgtgtaggctatttagaaggtgtccagtgtgaggtgcaactggtggagtctgggggaggcttggtccaggccgggggggtccctgagactctcctgtgcagcctctgcattcacctttagtaactatttaatgagctggggtcccncagcctcgagggaggcgtggaggtgggtgccagactaacttaaaccgagtagtacggaaccgtaagaaaaactactagtggtacggacttcgtaggtagggaaacggggtccgtagttccgacctactcctaccgaagacgaacaaccgaccaaagtacctctacgtgtacgactacgcaacgagtacgacggacgtagacggacggacggacgacgacgacgtgtacgtacgttcgtggtcgacgacgaccgaccccgaccgtacggaacggacgtacgacggtacgggtacgtacgtacgtacg

SEQ ID NO: 398562 - DNA, 588 bp, Homo sapiens
  misc_feature: GZ8MTXP02IM28L.38.4.A04.1.454.CMB.2.raw
  modified_base (287)..(287): a, c, t, g, unknown or other
  modified_base (299)..(299): a, c, t, g, unknown or other
  modified_base (320)..(320): a, c, t, g, unknown or other
  modified_base (329)..(329): a, c, t, g, unknown or other
  modified_base (418)..(418): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctggagactctcctgtgcagcctctgcattcacctttagtaactattaangagctgggtccnccagcctcgagggaaggggcnggagtgggngccagcaattaaaccaagatggaaccgtagaaaaaatctaatgtggaactcgtgtaggaacgggccgtaattcgacctatctccaaganacaacgacaaagaactcaactcgtgctgacacaattagaaacggcctagaggacggacgaacgacacgggctaggtcgttacttcgtgtcgacggacgaaccggcccccctaaagtcggaaacggggtcctaaaccggacggtagggggacgtactaaccgggtttaacg

SEQ ID NO: 398563 - DNA, 533 bp, Homo sapiens
  misc_feature: GZ8MTXP02JTO3B.38.4.A04.1.454.CMB.2.raw
  modified_base (406)..(406): a, c, t, g, unknown or other
  modified_base (412)..(412): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccgggggggtccctgagactctcctgtgcagcctctgcattcacctttagtaactattaatgagctgggtccgccagcctccaggggaaggggctggagtgggtggccaggcattaaaccaagatggaccgtagaaaaatactatgtggactctgtgaaagggccattcgccatctccaganacaacnccaaagaactcaactgtggctgcacatgaacggcctagagaggcgacgacacggctagtgttactcgtgtcgcggacgacgcccccagtcggaagggctacgagtgggacgcgtacgtacg

SEQ ID NO: 398564 - DNA, 562 bp, Homo sapiens
  misc_feature: GZ8MTXP02FHTN0.38.4.A04.1.454.CMB.2.raw
  modified_base (329)..(329): a, c, t, g, unknown or other
  modified_base (363)..(363): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagactcactgtggctgcacatgaacggcctgagaggcacgacacggctgtgtacttcngtgcgagacgcccccatgagggctacagtggganctacgactttgactactgggggccaggggaaccctggtccaccgtctcctcagccctccaccaagggcccatccggtcctccccctggccacccctcctaccaacgacgcacccgtcgtcgggggccacgacgccggcccgtggggcctcggccctgggtccaaggacctaacttcccacgttcgatccgactcgacgg

SEQ ID NO: 398565 - DNA, 595 bp, Homo sapiens
  misc_feature: GZ8MTXP02IXFEO.38.4.A04.1.454.CMB.2.raw
  modified_base (321)..(321): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggagcttggtccaggccggggggtcctgagactctcctgtgcagcctctgcattcactttaagtaactatttaaatgagctggtccgccagccctacgaggggaaggcnggagtgggtcggcagcaataaaccaagatggaacgtagaaaaaatacgtatgttggactcgtagtaggaaaagggcccgtaattcgacccaaattccgacccaaagaaacgaaacgaaaccgaacaaacgaaactacactagtacgcgcgacaacaagtacgaacggacgagaggaggacgaacgaacgacgacgtagtacgtacgttcgtcgtacgacgacgaaccgaccccgaccgaacgacggacgtacgaacggacggacgtacgtaacg

SEQ ID NO: 398566 - DNA, 526 bp, Homo sapiens
  misc_feature: GZ8MTXP02GWJHQ.38.4.A04.1.454.CMB.2.raw
  modified_base (301)..(301): a, c, t, g, unknown or other
  modified_base (345)..(345): a, c, t, g, unknown or other
  modified_base (370)..(370): a, c, t, g, unknown or other
  modified_base (415)..(415): a, c, t, g, unknown or other
  modified_base (436)..(436): a, c, t, g, unknown or other
  modified_base (465)..(465): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggcccgggggggtccctggagactctcctgtgcagcctctgcattcacctttagtaactattaatgagctgggtccnccagcctcgagggagggctggagtgggtgccagcataaccaagntggactagaaaaatcatgtggactntgtgaagggccatcgccatctcagagacaacgcaagactcactgngctgcacatcgaacgctgagnggcgacgacgacggctggtacgtacttcnggtcgacgacgacgcccccagtcggaacgggtctaacggcggtaggacgtacgtacgtacg

SEQ ID NO: 398567 - DNA, 570 bp, Homo sapiens
  misc_feature: GZ8MTXP02JJZU0.38.4.A04.1.454.CMB.2.raw
  modified_base (323)..(323): a, c, t, g, unknown or other
  modified_base (366)..(366): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaaggggctggagtgggtggccagcattaaccaagatggacgtgaaaaatctatgtggactctgtgaagggccattcgccatctcagagacaacgcaagactcactgtggctgcacatgaacggcctgagaggcgacgacacggctgtntacttctgtgcgagacgccccagtgagggctacgaggtggganctacgactttgactacgtggggccagggaaccctgtcacgtctcctcacgcctccacgaacggccatccggtccttccccgtcggccacccctcctaccgaagacggcctaccgtcgtgggggccacgacggccggcccgtgggccgtcggccgtcggtaccgaaggtacctaacgttacaaccgtgaactcgaactggacggg

SEQ ID NO: 398568 - DNA, 569 bp, Homo sapiens
  misc_feature: GZ8MTXP02GAN36.38.4.A04.1.454.CMB.2.raw
  modified_base (301)..(301): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtgctatttagaaggtgtcagtgtgaggtgcaactggtggagtcgtgggggaggcttggtccgaggccgggggggtccctggacgactctcctgtgcagcctctgctattctacctttagtaacttatttaatgagtcgtgggtccnccagccctccggaggggaaggggctggaggtggggcggccagcaattaaaccgagagtggaccgtaagaaaaatcgtatggtcgactcgtgtaggaacgggccgtattcgacctatctacagacgacaacgacaagactcacgtgtgctgacacgagacgaacgttccgagacgaggacgacgacgtacggctgtcgtacttcgtgtcgcgacgaccgcccccgagcggaacggactaacgggacggtacggacgtaccgtacgtacg

SEQ ID NO: 398569 - DNA, 578 bp, Homo sapiens
  misc_feature: GZ8MTXP02JL4EW.38.4.A04.1.454.CMB.2.raw
  modified_base (290)..(290): a, c, t, g, unknown or other
  modified_base (301)..(301): a, c, t, g, unknown or other
  modified_base (421)..(421): a, c, t, g, unknown or other
  modified_base (434)..(434): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccgggggggtccctggagactctcctgtgcagcctctgcattcacctttagtaactattaatgngactgggtccnccagccctccgagggaaggggctggaggtgggtggccagcattaaaccagatggacgtagaaaatctatgtggactcgtgtgaagggccgattcgcatctccagacgacacgacaagacncactgtgctgcanagtagacggcctagaggcggacgacgacgacggtctggtcgtaacgtttcgtggtcggacggtaacggacccgaccccccgtagtacgggaacggggaccttaacggacggggtacggggacgtaccgttaacggtttaaccgg

SEQ ID NO: 398570 - DNA, 552 bp, Homo sapiens
  misc_feature: GZ8MTXP02HNIQ3.38.4.A04.1.454.CMB.2.raw
  modified_base (329)..(329): a, c, t, g, unknown or other
  modified_base (362)..(362): a, c, t, g, unknown or other
  modified_base (382)..(382): a, c, t, g, unknown or other
  modified_base (442)..(442): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccagggaagggctggagtgggtgccagcattaaccaagatggacgtagaaaaatctatgtggactctgtgaaggccgattcgccatctcagagacaacgcaagaactcactgtgctgcacatgaacggcctgagaggcgacgacaggctgtgtacttctgngcgagacgcccccagtgaggctacaggtggganctacgtactttgacttacgnggggaccagggaacctgcaccgtctctcacgcctccacaacggccagtcgtccttccccngccaccctcctaccaagacgccacctcgcggggcacgacgccggccgtgggctcggcctcggtacaacggtacctaaccgttccacgttcgacgttcgacgttagacggg

SEQ ID NO: 398571 - DNA, 588 bp, Homo sapiens
  misc_feature: GZ8MTXP02J1S1O.38.4.A04.1.454.CMB.2.raw
  modified_base (260)..(260): a, c, t, g, unknown or other
  modified_base (352)..(352): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaagggctggagtgggtgccagcattaaccaagatggactagaaaaatctatgtgactctgtgaagggccattcgccatctcaganacaacgcaagactcactgtgctgcacatgaacgcctgagaggcgacgacacggctgtgtacttctgtgcgagcgcccccatggaggctacgnggtgggagctacgactttgactacgcggggccaacgggaccctggtccaccgtcctccctcacgccctccacccgaacgggcccctagtccggtcccttacccccgtcggccctaccccctaccctccaaacggacgaccaccgtccggtggggccaacgcgccggcccgtcggggcctcggtaccgttcggaccaacggacctaacgttccgaacgtcgactcgactcggacggg

SEQ ID NO: 398572 - DNA, 559 bp, Homo sapiens
  misc_feature: GZ8MTXP02F5MKW.38.4.A04.1.454.CMB.2.raw
  modified_base (286)..(286): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaaccaagatggacgtagaaaaatactatgtggactctgtgaagggccgattcgccatctccagagacaacgccaaagactcactgnggctgcacatgaacgcctgagaggcgacgacacggctgtgtacttctgtgcgagacgcccccatgagggctacaggtgggancgtacgactttgactacgtggggaccagggaacccgtggtcaccgtctctcacgccctcacacgggccacgtcgtcctccccgtcgccaccctcctccaacgcgacacctcgtcgggggcacgacgccggccgtcgggctcggccgtcggtacaacggtacctcgtacgacgtcgacgtcgacgtggacgg

SEQ ID NO: 398573 - DNA, 657 bp, Homo sapiens
  misc_feature: GZ8MTXP02I50HQ.38.4.A04.1.454.CMB.2.raw
  modified_base (290)..(290): a, c, t, g, unknown or other
  modified_base (304)..(304): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccaggccggggggtccctgagactctcctgtgcagcctctgctattctacctttagtaacttatttaangagcgtcgggtccnccagccctcggaggggaggggcgtagggaggtggggtcggacccaggacctaaacgttaaaccgaaggtacgtacgggaaccgttaagaaaaaattacgtaagtggtaggacttcgtgggtaggaacggggtccgtaatttccggaccattccctaccgaagaacgaaccaaccgacccaaagaacctacacgtgtacggctacgcaacacgtacggaaccggtccgtaggacggacgggaccgacggacgacggtcgtgtacgttacgttgtggtcggacgacggaccgacccccgtagtacggaacgggacgttaacggaggggtacgggacgtaccgttaacggttaccg

SEQ ID NO: 398574 - DNA, 668 bp, Homo sapiens
  misc_feature: GZ8MTXP02H1O9W.38.4.A04.1.454.CMB.2.raw
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggccgattcgccatctccagagacaacgcaagaactcactgtggctgcacatgaacgcctgagaggcgacgacacggctgtgtacttctgtgcgagacgcccccatgacggggctaacgaggtgggagctacggtacttttcgaaccgttacgtcgggggcccaacgggggaaacccccgtgggtcccgacccggttcctccctccgacgtccccctacccgaacccgaaacggggcccccaacgttcccgggttccctttccccccgtcgggccccctaccccctcccctacccgaaacgcgacccgtacccgtcggtcgggggccaaccgcggccgggcccgttcgggggcctcgggacccgtcgggtaccgaaacggtaccttaaccgtttcccgaacgttcgactccggaacgtggaccgggg

SEQ ID NO: 398575 - DNA, 648 bp, Homo sapiens
  misc_feature: GZ8MTXP02FU74E.38.4.A04.1.454.CMB.2.raw
  modified_base (333)..(333): a, c, t, g, unknown or other
  modified_base (345)..(345): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccaggggaaggggctggagtgggtggccagcattaaccaagatggacgtagaaaaaatctatgtggactctgtgaagggccgattcgccatctcagagacaacgccaaagactcactgtggctgcacatgaacgcctggagaggcacgacacggctgtgtacttcnggtgcgagaccncccccagtgacgggctacgaggtggggactcgtacgtacgtttagaccgttacggtcgggggacccggaaccggtaccgtcgtacccgtaccgtccttcacgaccgtccccaaccgaaccgggacccgaccgtcggttccccgttcccccgttcccggccgaccccttccccgttaccgaaaccgacgtacccgacccgtcggttcggggcggacacggccggccggtcggcgtcgtccgtcggtacgaaccggacgttacccttaaccgtacgtacgtacgtacgtacgtacggacggcggg

SEQ ID NO: 398576 - DNA, 623 bp, Homo sapiens
  misc_feature: GZ8MTXP02FXW8F.38.4.A04.1.454.CMB.2.raw
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaaggcatcgccatctcagagacaacgccaaagactcactgtgctgcacatgaacggcctgagaggcgacgacgacggctgtgtacttctgtgcgagacgcccccagtgagggctacgaggtgggagcgtacgactttacggaccttacgtcgggggaccaacggggtaaacccgtggtacccgacccgttctccctcgacgccctacccaacccgaacggggccccacgttcccgggttcccttcccccgtcgggcccctacccccttccgtacccgaaacgacgccctacccgtcggtcgggggaccacgacggccggcccgtagggcttcgccgtcggtacgaacggtacctaacgttcccgagttcgactcgacgtggacgg

SEQ ID NO: 398577 - DNA, 565 bp, Homo sapiens
  misc_feature: GZ8MTXP02HRRPJ.38.4.A04.1.454.CMB.2.raw
  modified_base (294)..(294): a, c, t, g, unknown or other
  modified_base (420)..(420): a, c, t, g, unknown or other
  modified_base (444)..(444): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtgctatttagaggtgtcagtgtgaggtgcaatggtggagtcgtgggggagcttggtccgaggccgggggggtcctgagctctcctgtgcagcctctgcattccacctttagtaaactatttaatgagtcgtcgggtccnccagccgtccgaaggggaaggggctgggaggtggggtcggccaggctaattaaaccgaagacgtggaaccgtagaaaaaacttcgtatgtggacttcgtgtaggaacgggcctagttccgacatcncagagacacacaagactcacgtgngctgcactagcgaacggcctggagacggacgacgacgacgggtctggtacttacgttcgtgtcggacgacgccgaccccgagtcggaacggtctaaggtcgagggacgtcgtacgtttacg

SEQ ID NO: 398578 - DNA, 578 bp, Homo sapiens
  misc_feature: GZ8MTXP02JA93Y.38.4.A04.1.454.CMB.2.raw
  modified_base (307)..(307): a, c, t, g, unknown or other
  modified_base (332)..(332): a, c, t, g, unknown or other
  modified_base (342)..(342): a, c, t, g, unknown or other
  modified_base (360)..(360): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagnggcgacggcacggctgtgtacttcngtgcgagacncccccatgagggctacgnggtgggancgtacgctttgactacgtgggggccagggaaccctggtccaccgtctcctcacgccctccaaccgacgggcccagtccggtcccttcccccgtcggcccacccctcctaccaacgacgcccaccgtcgtcgggggcaacgcggccggcccgtgggcctcggcctcgggtacaacggacctaacgttccgaacgtcgatcgacgtgacggg

SEQ ID NO: 398579 - DNA, 595 bp, Homo sapiens
  misc_feature: GZ8MTXP02FVE1X.38.4.A04.1.454.CMB.2.raw
  modified_base (301)..(301): a, c, t, g, unknown or other
  modified_base (325)..(325): a, c, t, g, unknown or other
  modified_base (358)..(358): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaaatctatgtggactctgtgaaggccattcgccatctcagagacaacgcaagactcactgtgctgcacatgaacggcctgagnggcacgacacggctgtgtacttcngtgcgagacgcccccatgaggctacaggtgganctacgactttgactacgtgggggccacgggaaccctggtccaccgtcctcctcacgccctccaaccgaacgggaccctacgtccggttcccttcccccgtcggccctacccctaccctacccgaaacgacgacctaccgtcgtcgggggccacgacggccggcccgtcgggccgtcggccgtcggtacgaacggtaccttaaccgttcccgacgttacgactacgaccgtggaccgg

SEQ ID NO: 398580 - DNA, 568 bp, Homo sapiens
  misc_feature: GZ8MTXP02IR01A.38.4.A04.1.454.CMB.2.raw
  modified_base (294)..(294): a, c, t, g, unknown or other
  modified_base (307)..(307): a, c, t, g, unknown or other
  modified_base (438)..(438): a, c, t, g, unknown or other
  modified_base (445)..(445): a, c, t, g, unknown or other
  modified_base (503)..(503): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggctttgggtccgaggcccgggggggtccctggagacctctcctgtgcagcctctgcattcacctttagtaacttattaangagcgtgggtccnccagcctccgaggggagggctggagtgggcggccagctaacttaaaccagagtggaaccgtaagaaaatactatgtcggactcgtgtaggaagggcctattcgcatcctacagagacaacgacaaagaccncacgtgngctgacacagtcgaaccgggctaggagacggcgacgacgcggactgtacgtacttcgnggtcgcggacgacccgcccccaagtggaacgggactacggaaggtgggacgccgttaacgttacg

SEQ ID NO: 398581 - DNA, 658 bp, Homo sapiens
  misc_feature: GZ8MTXP02IQ0W9.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctgggagtgggtggccagcattaaccaagatggacgtagaaaaatctatgtggactctgtgaagggccattcgcatctcagagacaacgccaagaactcactgtggctgcacagtcgaacggcctggagagggcgacgacgacggctgtcgtacttcgtgtgcgagaccgcccccatcggagggctacgaggtcgggatcgtacgtactttgaccttacggtcgggggccgtaaacgggtaacccgtcggtaccgtacccgtcctcctccgacgacccctcccgaacccgaaccgggccctaacgttcccgggtcccctttcccccgcggtccctacccctccctacccaacggacccgccgtaccgtcgggcggggaccacgccggcccggtcccgtcgggtccgtacggtccggtacggtaccgtaacggtaccttaaccgttaccgacggtacgacgtaccggtacgtacggacgg

SEQ ID NO: 398582 - DNA, 679 bp, Homo sapiens
  misc_feature: GZ8MTXP02FRFPF.38.4.A04.1.454.CMB.2.raw
  modified_base (255)..(256): a, c, t, g, unknown or other
  modified_base (259)..(259): a, c, t, g, unknown or other
  modified_base (278)..(278): a, c, t, g, unknown or other
  modified_base (290)..(290): a, c, t, g, unknown or other
  modified_base (292)..(292): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttccgtgttaggctattttagaaggtgtccagtgtgaggtgcaatggtggagtctgggggagcttggtccagccggggggtccctgagctctcctgtgcagcctnnctntctacttagtaactattangagcgtggtccncncgcctacggagggaggcgtggaggtgggtcgaccgagactaaacgtaaaccgaagtagtaggaacgtaagtaaaaactacgtagtggtacgtactcgtaggtaggaacgggccgtagttaccgacctacttacccgtacgaacggaacgaaaccaaaccgacccgaaaacgtaccgtacgtaacgtcggtacggaccgtacgacgaacgtacgtacggaaccggtaccggtacggaacggacgggaccggaaccggaaccggtaccggtacgtacggttacgttacgttacgttacggtacggtaccggtaccggtaccgtaccccgtaccggtacggtaacggtacgtaacggtacgggtacgggtacggtaccgtaacggttacg

SEQ ID NO: 398583 - DNA, 720 bp, Homo sapiens
  misc_feature: GZ8MTXP02G3EP8.38.4.A04.1.454.CMB.2.raw
  modified_base (330)..(330): a, c, t, g, unknown or other
  modified_base (374)..(374): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgaggggaaggggctggagtgggtggccagcattaaccaagatggacgtagaaaaatctatgtggactctgtgaagggccattcgccatctcagagacaacgccaagaactcactgtgctgcacatgaacgctgagaggcgacgacacggctgtgtacttcgngtgcgagaccgcccccaagtggacggactacgacgggtgggacnccgttacgtactttggaaccgttacggtcgggggaccctaacgggggtaaacccctcgggtacccgtacccggttccctccctaccgaccgtccccgtaccccgaaacccggaaaccgggcccccgtaacgttccccggttcccctttaccccccggtccgggtcccctaaccccctttaccccgtaacccgaaacggaccggaccctaacccgttccgggtaccgggggaccaaccgaccgggcccgggtccccgtcgggggcctcggccggttcggttaaccgaaacgggtaccttaaccgttcccgaacggttacgtaacgtaccggtacgtacggaccgggg

SEQ ID NO: 398584 - DNA, 542 bp, Homo sapiens
  misc_feature: GZ8MTXP02FQ74O.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccggggggtccctgagactctcctgtgcagcctctgcattcacctttagtaactatttaatgagtctgggtcccgccagccctccgagggaggggctggagtggggtggccagcattaaccaagatggaccgtagaaaaatctatgtgactcgtgtggaagggcctattcgccatctccagagacaacgccaaagactcaactgtaggctgacacagtagaaaccggcctagaagaggcgaacgacacggctgtcgtacttcgtgtcgcgagaccgcccccagtcggaaggctacgaggtgggacgcgtacgtacg

SEQ ID NO: 398585 - DNA, 723 bp, Homo sapiens
  misc_feature: GZ8MTXP02INYQA.38.4.A04.1.454.CMB.2.raw
  modified_base (260)..(260): a, c, t, g, unknown or other
  modified_base (302)..(302): a, c, t, g, unknown or other
  modified_base (316)..(316): a, c, t, g, unknown or other
  modified_base (330)..(330): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggcttgagtgggtggccagcattaaccaagatggacgtagaaaaatctatgtggactctgtgaagggcattcgcatctcaganacaacgcaagactcactgtggctgcacatggaacgcctgagnggcgacgacacggntgtcttacttctgngcgagaccgcccctaagtggacggtctacgaggtgggatccgtaacgtactttcgacgttaccggtcgggggacccgaacggggtaacccttgggtaccctacccgtccttcccgtccgaccgaccccgtacccgaaacccgaaaccggggtcccctaacgttccccgggtttccccttttaccccccgcgggtacccctacccccctttaccgtaccccgaaagtacccgacccgtaacccggttcgggtaaccgggggccaaaccggaaccgggccccgggtaccccggttgggggcccttacgggcccggtttcgggaaaccgtaaacgggtacccttaaaccgttcccgaaacgttcggaaccgtaccggtaacgttcgggaaccgggg

SEQ ID NO: 398586 - DNA, 582 bp, Homo sapiens
  misc_feature: GZ8MTXP02FRUNM.38.4.A04.1.454.CMB.2.raw
  modified_base (305)..(305): a, c, t, g, unknown or other
  modified_base (569)..(569): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaaggccgattcgccatctccagagacaacgccaaagactcactgtgctgcacatgaacggcctggagngggcgacgacacggctgtgtacttctgtgcgagacgcccccatgagggctacgaggtgggatcgtacgacttttgaaccgttcgtcgggggccaacggggaacccgtggtacctaccgtctcctcacgccctccaaccgaacgggacccacgtccggttcccttcccccgtcggcccaccccttcctacccaacgacgccgacctcggtcggggcacgaggccgcccgtggctcgccgtgtaccgaggtacctcgtccacgtanctacgactgacgg

SEQ ID NO: 398587 - DNA, 846 bp, Homo sapiens
  misc_feature: GZ8MTXP02G27V1.38.4.A04.1.454.CMB.2.raw
  modified_base (265)..(265): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccaggggaaggggctggagtgggtggccagcattaaccaagatggacgtagaaaaatctatgtggactctgtgaagggccgattcgccatctccaganacaacgcaaagactcactgtggctgcacatgaacggcctgagaggcgacgacacggctgtgtacttctgtgcgacgacgcccccctaagtcgacgggctaacgaggtcggggaacgccgttaaccggtacttttggaacccgttaacggtcggggggaccctaaacgggggtaaaccccctgggggttaccccaacccggttccctcccgttcccgaaccgtccccctaccccgaaccccggaaaccggggacccccctaacggtttccccggggtttaccccccgtttcccccccggttacggggccccctaaccccccttcccccgttaaccccggaaaaccgtccgggaccctaaccccggttcccgggtaacgggggggtcccctaaaacccggaacccggggttcccccgggggaccccccggtttcggggggcccccgtttcccgggggtaacccccggttttagggggtaaacccccggaaaaccgggggttaaacccttaaccccgttttaccccggaaccggttacgggtaaacctttcccggggaaacccgtttaggggtaaacccggggg

SEQ ID NO: 398588 - DNA, 650 bp, Homo sapiens
  misc_feature: GZ8MTXP02F9MCW.38.4.A04.1.454.CMB.2.raw
  modified_base (301)..(301): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccattccttcctgtctgcatcgtggtaggggacagagtcaccatcacgttcggccgggccaggtcagggctagttaggacttcgttagcctggtatcaagacaaaacgagggaacacccctaactctagatctatggtnctatcctatttgacgaaaggttcggggtacccagtacgtaaaggtcaggcgacagtggatcgtaggacagtattcagtctacaactaatcgagaccagtccctgactacggcccgtaggaacgtacttaacgtcgtaactaactttagttatttacgtactaacgtacgttaacctttaaaccgttaacccgttaacccccgtaagttacccgtttacggggaacccggtaacgggtaccgtaaagggtttacggaaacgtaacgttaaaccgaaaacccgtaggtacgtaccgggtactacggaacctaacctaagtttccgtcgttacccttactaccgtttccccg

SEQ ID NO: 398589 - DNA, 544 bp, Homo sapiens
  misc_feature: GZ8MTXP02JD0TQ.38.4.A04.1.454.CMB.2.raw
  modified_base (302)..(302): a, c, t, g, unknown or other
  modified_base (426)..(426): a, c, t, g, unknown or other
  modified_base (433)..(433): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctggagactctcctgtgcagcctctgcattctacctttagtaacttatttaatgagctgggtccnccagcctccgagggaggggctggagtgggtgccagcataaccagatggacgtagaaaaatctatgtggactcgtgaggacggccgagttcgctatctcagagacaacgccaaagactacactgngctgcanagtcgaacgccgagagaggacgacgacgacggtcgtgtcgttacttcgtagtcgcgacgacccgcccccagtcggaacgggcctaggacggtcgggacgtccgtacgtacg

SEQ ID NO: 398590 - DNA, 631 bp, Homo sapiens
  misc_feature: GZ8MTXP02GZCIB.38.4.A04.1.454.CMB.2.raw
  modified_base (371)..(371): a, c, t, g, unknown or other
  modified_base (380)..(380): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtggaagggccgattcgccatctcagagacaacgccaagaactcactgtggctgcacatgaacggcctggaagagggcaacgacacggctggtgtacctttctggtgcgagccgcccccagtggagggctacgnggtgggganccgttacgtactttgacgtacgtgggggccaacggggaaccctggtccaccgtctaccctcgacgccctccacccgaacgggcccacgttcccggtcccttcccccgtcggaccccaccccttcccacccgaaagccgccgaccgtcggtcgggggcacgacggtccggcccgtggggtcctcggccgtcggtaccgaacgggtaccttaaccgttacccgacggttacgaacgtccggacgtcggacggg

SEQ ID NO: 398591 - DNA, 624 bp, Homo sapiens
  misc_feature: GZ8MTXP02HL32Q.38.4.A04.1.454.CMB.2.raw
  modified_base (257)..(257): a, c, t, g, unknown or other
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaatactatgtggactctgtgaaggccattcgccatcnccagagacaacgccaagaactcactgtggctgcacatggaacggcctgagaggcgacgacacggctgtgttacttctggtgcgagccgcccccagtggaggctagaggtgganctacgactttgacctacgtggggccaacgggaccctgtccacccgtcctccctcacgccctacccaacccgaacgggccccacgtcccggttccccttcccccgtcggtacccaccccttccctacccgaacgaccgacccaccgtccggcgggggaccaacgacggtcccggtcccggtcggccgtacggccgttacggaccgtaacggtacctaaccgttaccgtacggtcgacgtaccgtacgtggacggg

SEQ ID NO: 398592 - DNA, 561 bp, Homo sapiens
  misc_feature: GZ8MTXP02JL6N9.38.4.A04.1.454.CMB.2.raw
  modified_base (287)..(287): a, c, t, g, unknown or other
  modified_base (299)..(299): a, c, t, g, unknown or other
  modified_base (493)..(493): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggcccgggggggtccctgagactctcctgtgcagcctctgcattcaccttagtaactatttaangagctgggtccnccagcctcgagggagggctggagtgggtggccagcaataaccagatggaccgtagaaaatactatgtggactcgtgtgaagggccattcgcatcctcagagacaacgccaagacctacactgtcgactgcgacacgtgaacggccgtaggacgacgggaccgacggacgtaccgggctggtacgtaccgttcgngtacggcgaacggaccgcccccaagtcggaacggtcaacgtagggtcgggacgtaccgtaacgttacg

SEQ ID NO: 398593 - DNA, 538 bp, Homo sapiens
  misc_feature: GZ8MTXP02IQ1V0.38.4.A04.1.454.CMB.2.raw
  modified_base (284)..(284): a, c, t, g, unknown or other
  modified_base (295)..(295): a, c, t, g, unknown or other
  modified_base (389)..(389): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccagccggggggtccctgagactctcctgtgcagcctctgcattcacctttagtaactatttaangagctggtccnccagcctccgagggaaggggctggagtgggtgccagcattaaccagatgacgtagaaaatctatgtggactctgtagaagggccagttcgctanctccagagacacgaccaagactcactgtgctgcacagtgaaccggcgtacgaggaggacgacgaacgacggcgtagtcgttacgttcctggtcgacggacgacgaccccccgagtcggaaggctaacgaggtcggacgtctacgttacg

SEQ ID NO: 398594 - DNA, 556 bp, Homo sapiens
  misc_feature: GZ8MTXP02G62J2.38.4.A04.1.454.CMB.2.raw
  modified_base (301)..(301): a, c, t, g, unknown or other
  modified_base (327)..(327): a, c, t, g, unknown or other
  modified_base (340)..(340): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccagggccggggggtcctgagtactctcctgtcgcacgcctctgctattctacctttagtaactattaatgagcgtggtccnccagcctcgagggaggctggagtggngcagcataacagntgacgtagaaatctatgtagactcgtgtaggaagggcctagttcgctatctcgagacacaacgaccaaagacctcacgtgtggacctgaccacgagtaggaaccggcgtaaggacgacggacgacgacgacggtctgtcgtactcgtgcgcgacgaccgacccccaggtacggaaggtacctacgtacgggtacggggactaccgtacggttaccg

SEQ ID NO: 398595 - DNA, 581 bp, Homo sapiens
  misc_feature: GZ8MTXP02GGMY0.38.4.A04.1.454.CMB.2.raw
  modified_base (357)..(357): a, c, t, g, unknown or other
  modified_base (365)..(365): a, c, t, g, unknown or other
  modified_base (372)..(372): a, c, t, g, unknown or other
  modified_base (383)..(383): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaagggccattcgccatctcagagacaacgccaagactcactgtgctgcacatgaacgctgagaggcacgacacggctggtgtacttctggtgcgagccgcccccagtggaggctacgnggtgggancgtacgntttgactacgnggggccagggaaccctggtcacccgtctcctcacgccctaccaacccgacgggccctacgtccggttcccttcccccgtcggcccacccctccctaccgaaacgcgaccaccgtcgcgggggccacgcgccggcccgtgggctcgccgtcggtacgaacggtactaaccgtccgtacgtcgacgtcgacgtggacggg

SEQ ID NO: 398596 - DNA, 536 bp, Homo sapiens
  misc_feature: GZ8MTXP02I3LDZ.38.4.A04.1.454.CMB.2.raw
  modified_base (434)..(434): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactatttaatgagctgggtccgccagcctccgagggaaggggctggagtggtggccagcaattaaccaagatcggacgtagaaaaatctatgtgactctgtgaaggccgattcgcatctccagagacaacgacaagaactcaactgtcggctgcacntagaacgcctgagaggcgacgacacggctggtcgtacttcgtgtacgcgacgaccgcccccgaagtcggacggggacctacgaaggtgggacgtcgttaacg

SEQ ID NO: 398597 - DNA, 717 bp, Homo sapiens
  misc_feature: GZ8MTXP02H16JQ.38.4.A04.1.454.CMB.2.raw
  modified_base (272)..(272): a, c, t, g, unknown or other
  modified_base (295)..(295): a, c, t, g, unknown or other
  modified_base (472)..(472): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatcgtgtaggggacagagtcaccatcacttgccgggcagtcgagggctagttaggactcgttagcctggtatcagacaaaaacgagggaaacncccctaactctagatctatggtnctatcctattttgacgtaaaaggttcggggtaccctagtacgtaaaggttcgaaggcggaccgagggttggactcggtagggaactaaggtatttcgaagtcctacaacaaatccaaggccaagccctagccgaacggcccgtaggaacgtacttaacgtacgtacttaaaactttntttaaagttcgtacttaaacgtaacgttaacctttaaaacgtttaacccgttaaaccccctaacgttttaaccgggttttacgggaacccggttaaacgggggtaaacccgtaaaagggtttacgggaaaacgtttaccgaaaaccgtaaaaccggtaaagttccggggtaacggtccgttaccgaaccgttaaacccgtaatttccggttacgtttacccgttaccgttaaccgtttacccccg

SEQ ID NO: 398598 - DNA, 565 bp, Homo sapiens
  misc_feature: GZ8MTXP02F1BCG.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcttggtccgagggccggggggtcctgagactctcctgtgcagcctctgctattcacctttagtaacttatttaatgagcgtgggtacgccagcctccgagggaaggggctggagtgggtgccagcaataaccaagataggaccgtaagaaaaatctatgtagactcgtgtagaaggggccattcgccatcctacagagaacaaccgcaaagacctacactgtacgctgcaacagtagaaccggtcctaggaacggacggacgacgacgacggctggtcgtacttctggtcgcgacgaccgacccccgtagtcggaacggtcaacgagggtgggaacgccgtacgtaaccg

SEQ ID NO: 398599 - DNA, 536 bp, Homo sapiens
  misc_feature: GZ8MTXP02FJ3SW.38.4.A04.1.454.CMB.2.raw
  modified_base (301)..(301): a, c, t, g, unknown or other
  modified_base (335)..(335): a, c, t, g, unknown or other
  modified_base (385)..(385): a, c, t, g, unknown or other
  modified_base (407)..(407): a, c, t, g, unknown or other
  modified_base (526)..(526): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttggtccaggccgggggggtccctgagactctcctgtgcagcctctgcattcacctttagtaactatttaatgagctggggtccnccagcctccgaggggaaggggctgggagtggggnggccagcaattaaccaagatggaccgtagaaaaatactatgtggactcgngtagaaggggccattcgcatcnccagagacacgcaaagactcactgtgctgcacactgaaccggctagaggaggcgacgacacggctgtgtacttcgtgtcgcgagaccgcccccagtgaacggggctacgaggtgggacncgtacgtacg

SEQ ID NO: 398600 - DNA, 576 bp, Homo sapiens
  misc_feature: GZ8MTXP02H2321.38.4.A04.1.454.CMB.2.raw
  modified_base (341)..(341): a, c, t, g, unknown or other
  modified_base (371)..(371): a, c, t, g, unknown or other
  modified_base (403)..(403): a, c, t, g, unknown or other
  modified_base (456)..(456): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtcgtggggggaggcttggtccgagggcccgggggggtccctggagactctcctgtgcagcctctgcattcacctttagtaaactatttaatgagcgtgggtcccgcagccctcgagggaggggctggagtgggtgccngcataacagatggactagaaaaatctatgnggactcgtgtggaagggccgattcgctatccncagacgacacgacaaagactcactgtcggactgacaacatagaaaccggtcgnggaagacggggacgaaccggacaccggggtctcgttacgtcttcgtggcgaccggacgaccccgaccccgtaggacggaacggtacgtaacggtacgggtcggaaccgtcgtaacgtacg

SEQ ID NO: 398601 - DNA, 709 bp, Homo sapiens
  misc_feature: GZ8MTXP02GX9EM.38.4.A04.1.454.CMB.2.raw
  modified_base (329)..(329): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccattcgccatctcagagacaacgcaaagactcactgtggctgcacatcggaacgcctgagaggcgacgacacggctgtgtacttntgtgcgagaccgtcccccactgggacgggtcctacgaggttcggggagtccgttaacgtacgttttgaacccgttaccggtacgggggacccgaaacggggtaaccccgttcggtacccgtacccgttccctacccgtacccgaacggtccccctacccgaaccccgtaaaccggggacccctaacggtttcccggttcccccgtttccccccgtccggtccccgtacccccttacccgtacccgaaacgaccggaccctaacccgtcggtccgggggaccacgtaccggccgggccccggttgggccgtacggccgttacggaccgtaacggtaccttaaccgtccgtaacggttacgacgttccgacgtcggaccggg

SEQ ID NO: 398602 - DNA, 522 bp, Homo sapiens
  misc_feature: GZ8MTXP02FPH31.38.4.A04.1.454.CMB.2.raw
  modified_base (287)..(287): a, c, t, g, unknown or other
  modified_base (299)..(299): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcttggtccaggccggggggtccctgagactctcctgtgcagcctctgcattcacctttagtaactatttaangagctgggtccnccagcctccgagggagggctggagtgggtgccagcattaaccaagatggaccgtagaaaatctatgtggactctgtgaaggccgtattcgccatctccagagacaacgcaagactcactgtagctgcacagtagaacggcctagagaggcgacgacacggctgtgtacttctgtcgcgacgaccgcccccagtcgaaggctacgaggtggacgcgtacgtacg

SEQ ID NO: 398603 - DNA, 617 bp, Homo sapiens
  misc_feature: GZ8MTXP02IQH00.38.4.A04.1.454.CMB.2.raw
  modified_base (567)..(567): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccgaggccgggggggtccctggagactctcctgtgcagcctctgctatcacctttagtaactatttaatgagctggtccgcacgcctccgaggggaagggcgtggaggtgggtggccgagactaattaaaccaaggatacggacgtaagaaaaatactagtgtaggctcgtagtaggaacgggccgtagttccgaccacgtcctccaagacgaacaaccgaccaaagaacctcaactggtacgctagccaacgagtacggaaaccggtccaggaacgaggaccgacgacgacgggtctggtcgttacgttcgtacggtcgcggaacggaccccgtaccccccgngtaacgggacgggtaccgttacggacgggtcgggacgtacgttaaaccgg

SEQ ID NO: 398604 - DNA, 533 bp, Homo sapiens
  misc_feature: GZ8MTXP02HQOIJ.38.4.A04.1.454.CMB.2.raw
  modified_base (295)..(295): a, c, t, g, unknown or other
  modified_base (369)..(369): a, c, t, g, unknown or other
  modified_base (513)..(513): a, c, t, g, unknown or other
  modified_base (523)..(523): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaggtgtccagtgtgaggtgcaactggtggagtcgtgggggaggcttggtccaggccgggggggtccctggagactctcctgtgcagcctctgcattcaccttagtaactattaatgagctggtccnccagcctcgagggaggctggagtgggtgccagcattaaaccagatggaccgtagaaaaaatctatggtagactntgtagaaagggcctattcgcctaatcctaccagacacaacgccaaagaacctcactagtgctgcacatgaacgctgagacggacgacgacgacggctgtcgtacttctggtacacggacgccgcccccatggaacggtctacgnggtcgggacncgtacgtacg

SEQ ID NO: 398605 - DNA, 581 bp, Homo sapiens
  misc_feature: GZ8MTXP02JNYKZ.38.4.A04.1.454.CMB.2.raw
  modified_base (301)..(301): a, c, t, g, unknown or other
  modified_base (333)..(333): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcgttggtccgaggccgggggggtccctgagactctcctgtgcagcctctgcattcacctttagtaacttattaatgagctgggtccnccagcctccgaggggaggggctggagtggggngcccagcattaaaccaagtagtaggaaccgtagaaaaatctagtggtacggactcgtggtaggaacggggccgtattcgcctatctccagacgaacaacgaccaaagacctacacgtagtcgctgcacagtacgacgcctaggagaggacgacgacgacggtcgtgtcgttacttcgtggtcgacgacgaccgacccccgagtacggaacgggcctacggacggtagggacgtaccgtacggttaacg

SEQ ID NO: 398606 - DNA, 582 bp, Homo sapiens
  misc_feature: GZ8MTXP02GAN8Z.38.4.A04.1.454.CMB.2.raw
  modified_base (270)..(270): a, c, t, g, unknown or other
  modified_base (442)..(442): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtaggggacagagtcaccatcacttgccgggcagtcagggcattaggacttcgttagcctggtatcagacaaaaaccgagggaaacncccctaacctcctagatctagtggtgcatcctattttgacgtaaaaggtcggggtacccagtacgtaaggttcaggcggaccaggtgatcgtaggacagtattcagtctacactaatcagcagcctagacagccgtagacgtatactgactaactttattattacgtactanagtactttaaactacccgttacccattaccgtttaggaccgtaggggtaaccctaaggttaggaacgtactaacgaaaacgtacgtacgtacggtactacgaacctaccgacttccgttacttccttactactttccccg

SEQ ID NO: 398607 - DNA, 568 bp, Homo sapiens
  misc_feature: GZ8MTXP02INEM6.38.4.A04.1.454.CMB.2.raw
  modified_base (446)..(446): a, c, t, g, unknown or other
  modified_base (495)..(495): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggccgggggggtccctgagactctcctgtgcagcctctgcattcacctttagtaacttatttaatgagcgtgggtccgccagccctccgaggggaaggggcctgggagtggggtggcccagcattaaccaagatggaaccgtagaaaaatactagtgtgactcgtgtggaacgggccagttcgccatctcagacacaacgacaagactcactgcggctgcanagtgacggccgagaggacggacgacgacgacggcgtgtcgttacttcgnggtcggacgacgaccgacccccacgtcgggaacggacgtaaccggaggtacgggacgtaccgtacggttaccg

SEQ ID NO: 398608 - DNA, 546 bp, Homo sapiens
  misc_feature: GZ8MTXP02H4XIG.38.4.A04.1.454.CMB.2.raw
  modified_base (393)..(393): a, c, t, g, unknown or other
  modified_base (419)..(419): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccgggggggtccctggagactctcctgtgcagcctctgcattcacctttagtaactatttaatgagcgtgggtccgccagccctccgagggaggctggagtgggtgccagcataaccagatggacgtagaaaatcatgtggactgtgtagacgggcattcgctatcncagacgacaacgcaaagactcactgngctgacacatgaaccggctgagaggcgacgacgtacggactgttacgtacttcgtggtcgacgacgaccgcccccgagtcgggaacggccttaacgaggggtacgggacgtaccgttaacggttacg

SEQ ID NO: 398609 - DNA, 669 bp, Homo sapiens
  misc_feature: GZ8MTXP02GA1Q7.38.4.A04.1.454.CMB.2.raw
  modified_base (267)..(267): a, c, t, g, unknown or other
  modified_base (281)..(281): a, c, t, g, unknown or other
  modified_base (346)..(346): a, c, t, g, unknown or other
  modified_base (378)..(378): a, c, t, g, unknown or other
  modified_base (403)..(403): a, c, t, g, unknown or other
tcagtcgatcacgtcacgaccggtgctcgatttagagtagtgatcagggggaagaccgatgggcccttgggagaggcttggtccagccgggggggtccctgagactctcctgtgcagcctctgcattcaccttttagtaactatttaatgagctgggtccgccagcctccgaggggaaggggctggagtgggtggccagcaattaaccaagatggacgtagaaaaaatctatgtggactctgtgaagggccattcgccatctcaganacaacgcaagaacncactgtggctgcacatgaacggcctgagaggcgacgacacggctgtgtacttctgtgcgagaccnccccccccagtggacgggctacgagtgggganctacgacttttagacctttaacggngggggacccacggggaaaccctggttacccaacccgttctccctaccacggtccctacccgaccgaaaccgggcccctaacgttcccgggtccccttccccccgttgggaccccctacccccttccacccccgaagccggtacccaccgttcggcgggggacaccgacggccccggcccgttaggggcccttcggccgttacgggtaccgaaacgggtaacccttaccgttacccgtaacgggtctaacgttcccgaacggtcggg

SEQ ID NO: 398610 - DNA, 844 bp, Homo sapiens
  misc_feature: GZ8MTXP02IVUH6.38.4.A04.1.454.CMB.2.raw
  modified_base (262)..(262): a, c, t, g, unknown or other
  modified_base (267)..(267): a, c, t, g, unknown or other
  modified_base (286)..(286): a, c, t, g, unknown or other
  modified_base (294)..(294): a, c, t, g, unknown or other
  modified_base (307)..(307): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcacctttagtaactatttaatgagctgggtccgccagcctccgaggggaaggggctggagtgggtggccagcattaaaccaagatggacgtagaaaaatctatgtggactctggtggaaggccgattcgcatcncaganacaacgcaagactcactgnggctgcanatgaacgctgagnggcgacgacacggctgtcgttacttcgtgtcgacgagaccgcccccagtagggacgggacctaacgagggtcgggacgtcgtaacgttacgtttacggaaccgttacggtacgggggacccgtaacggggtaaacccccgttcgggttacccgtaacccggttcccttacccgtacccgtaaccggtaccccccttaacccggaaacccccggtaaaacccgggggcccccttaaccgggtttcccccgggtttcccccccgttttccccccccggttacccggggtaccccccttaaccccccctttacccccgttaaaccccgaaaacccggtaacccggccccttaacccccggtttccgggggtacccggggggtaccaacccgggaaccgggggtccccggggtccccggtttccgggggcccttaaccggggtccccggttacggggtaaacccgtaaccggggttaacccttaaccccggttaccgtacccggtagttaaccgttccggaacggttcggggaaccggggg

SEQ ID NO: 398611 - DNA, 534 bp, Homo sapiens
  misc_feature: GZ8MTXP02FUTMH.38.4.A04.1.454.CMB.2.raw
  modified_base (423)..(423): a, c, t, g, unknown or other
  modified_base (430)..(430): a, c, t, g, unknown or other
  modified_base (444)..(444): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcttggtccaggccggggggtcctgagactctcctgtgcagcctctgcattcacctttagtaactatttaatgagctgggtccgccagccctccgaggggaggggctggagtggggtgccagcattaaccgaagatggacctagaaaatactatgtggactgtgtggaagggccgattcgcatctcagagacaacgccaagactcactgngctgcanatgacggctagagnggcgacgacacggctgtcgtactcgtagtcgacgacgaccgtcccccgaagtcggaacgggtctacgaggtcgggagaccgtacgttacg

SEQ ID NO: 398612 - DNA, 622 bp, Homo sapiens
  misc_feature: GZ8MTXP02GAEMI.38.4.A04.1.454.CMB.2.raw
  modified_base (328)..(328): a, c, t, g, unknown or other
  modified_base (363)..(363): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtgaaaaatctatgtggactctgtgaagggccgattcgccatctccagagacaacgccaagaactcactgtggctgcacatgaaccggcctgagaggcgacgacacggctggtntacttctgtgcgagcgcccccagtgagggctacgnggtgggancgtacgactttgactacgtggggaccagggaaccctggtccacgtctcctcacgccctcaccgaacgggcccagtccggtacccttccccgtcggcctaccccgtcctaccgaacgtaccgaccgacccgttcggtacgggggaccacgaacggcccgggtccccgttggggaccgtcggtcccgttacgggtaccgaaacggtaccgtaaccttccgaaacggttcgacgttccggacgttcggaacggg

SEQ ID NO: 398613 - DNA, 588 bp, Homo sapiens
  misc_feature: GZ8MTXP02G4OEG.38.4.A04.1.454.CMB.2.raw
  modified_base (360)..(360): a, c, t, g, unknown or other
  modified_base (367)..(367): a, c, t, g, unknown or other
tcagtcgatcacgtcacgaccggtgctcgatttagagtagtgatcagggggaagaccgatgggcccttgggagaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaagggccattcgcatctccagagacaacgccaagaactcactgtggctgcacatgaacggctgagaggcgacgacgacggctgtgtacttctgtgcgagcgcccccccatggaggctacgnggtgggngctagactttgactacgtggggccacgggaccctggtccaccggtctcctcacgccctaccaccgacgggccctacgtccggtcccttcccccgtggccctacccctccctacccaacgacgccaccgtcggtaggggccacgacggcccggccgtcgggcctcggtccgtcggtaccgaacggtccttaccttcccgacggtcgacgttcggacgtcggg

SEQ ID NO: 398614 - DNA, 589 bp, Homo sapiens
  misc_feature: GZ8MTXP02G8R27.38.4.A04.1.454.CMB.2.raw
  modified_base (291)..(291): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttgggtccaggcccgggggggtccctggagactctcctgtgcagcctctgcattcacctttagtaactatttaangagcgtgggtcccgccagccctccgaaggggacggggctggaggtggggtcgccagcaattaaaccagatggaacgtagaaaaatctatgtgactgtgtggaagggccattcgcctatcctccagagaacaacgccaaagaactcactgtaggctgaccacagtacgaacggccgtagagagggacgaacggacgacggtcgtagtgttaccttgtggtcggaccgaagacccgaccccccgtagtacggaacggggtccaacggtacgggtaggggacgtaccgttaacggtaaccg

SEQ ID NO: 398615 - DNA, 618 bp, Homo sapiens
  misc_feature: GZ8MTXP02JXPDQ.38.4.A04.1.454.CMB.2.raw
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggcccggggggtccctgagactctcctgtgcagcctctgctattcacctttagtaacttatttaatgagcgtgggtccnccagccctcgagggagggctggagtgggtcgccagcattaaaccaagagtaggaaccgtagaaaaaatactaagttggtaggacttcgtagtagggaaacggggccgagtttcgccctatcctaccgaagacgaaccaaaccgacccaaaagaaccctacactaggtcggcctcggacacgaagttacggaaaccggtcccgtaggaaacgggacgggaccgaacggaaccgacgggtccgtgttacgtaccttcgtggtcgacggcgaccgcccccgatcgggaacggtctacgcggtaggacgactacgtacg

SEQ ID NO: 398616 - DNA, 577 bp, Homo sapiens
  misc_feature: GZ8MTXP02HO5G0.38.4.A04.1.454.CMB.2.raw
  modified_base (502)..(502): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctggagactctcctgtgcagcctctgcattcacctttagtaactatttaatgagctcgggtccgccagccctcgaggggaaggggctggagtggggtcggacctaggcaattaaacccgaagagtggaaccgtagaaaaatctaatgtaggactcgtggtagaacgggccgtattcgccatctacagacgacaacgaccaagactcactgtgctgcacatacgaacggctagagacggcgacgacgacggctgtcgttacttcgnggttcgacggacgacccgccccccgagtacggaaccgggtactacggaggtacgggacgtaccgtaagttacccg

SEQ ID NO: 398617 - DNA, 765 bp, Homo sapiens
  misc_feature: GZ8MTXP02ISTQF.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggcagtcagggcattaggactcgttagcctggtatcagacaaaaaccagggaaacgcccctaactcctgatctatggtgcatcctattttcgacgtaaaaggttcggggtaccccagtaccgtaaacgggtttccaaggccggtaccgtagggttcggggaacgtttccggttacgggggaaacctaaagggtaacttttaccgtaacggttacccttacccgaaacctaaaactttcccgaaacggtcccgtaaacggccccgttacgggaccaaacgggtcccgttaaggggaacggtaaactttaccgtacggtacctaaacgttttaatttacgttttacgtaccttacgtaacgttacctttaaaactaacccgtttaacccccctacttaaccgtttttcgggaccgtaaacgggggtaccctaaaggggtttacggaaacggtaacgttaaccgtaaaaaccggtaacgttcgggttaacggggtccttacgggaacctaaaccccgttattaccctttggttaccctttcgtaactttcccccg

SEQ ID NO: 398618 - DNA, 570 bp, Homo sapiens
  misc_feature: GZ8MTXP02IUX06.38.4.A04.1.454.CMB.2.raw
  modified_base (297)..(297): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtgggttttccttgttgctatttagaaggtgtccagtgtgaggtgcaactggtggagtcgtgggggaggcttggtccaggcccggggggtcctgagactctcctgtgcagcctctgcattcacctttataacttattaatgagctgggtccnccagcctccgagggaggggctggagtggtggcccagcataaccagatggacgtagaaaatctaatgtaggactcgtggtggaaacgggcctagttcggaccattccgacaagacgaacaaacgaccaaagacctacaactggtgctggacaacacgtcgaaccgggtccagacggaggaccgacggacgacggctggtacgttacgttcgtggtgcggacgccgacccccagtcggaacggggccacggtacgggaggacgtacgtacgtacg

SEQ ID NO: 398619 - DNA, 716 bp, Homo sapiens
  misc_feature: GZ8MTXP02IWSTF.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgtggtttctgtgctatttagaaggtgtcagtgtgagtgcaacgtggtggagtcgtgggggaggcttggtccgaggcccgggggggtccctggagactctcctgtgcagcctctgctattcacctttagtaaacttatttaatgagtccgtgggtcccgccacgcccgtccggaggggtaagggggcttaggggaggttcggggcggacccgaaggaacgtcttaaaacccgaaaggtacgtacggggtaaaccgttaagaaaaaaacttacgttaagtggttacggacttccgtttagggtagggtaaaccggggccgtaacttccggcctaaactcccgtacccgaagaaacgaaccaaacccggacctaaacgaactccgtaacgttggtcgggacctcggccaaacgtacgtacggaaccgggccgtaaggacggaacgggaccggaacgtaaccggaccgggtacgttgtacgtttaccgttcgttaggtcggaccggaacgaccccgcccccgaaggtcgggaacggaccttacggagggtacgggccgtaccgtaacggtttccg

SEQ ID NO: 398620 - DNA, 612 bp, Homo sapiens
  misc_feature: GZ8MTXP02H048Q.38.4.A04.1.454.CMB.2.raw
  modified_base (374)..(374): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccaggggaaggggctggagtgggtggccagcattaaccaagatggacgtagaaaaatactatgtggactctgtggaagggccgattcgcatctcagagacaacgccaagaactcactgtggctgcacatgaacggcctgagaggcgacgacacggctgtgtacttctgtgcgagacgcccccagtcggaggctacgaggtgggganccgtaacgtacttttgaccttacgtcgggggaccaaacggggaacccgtggtccctacccgtctcccgtcacgccccgtccaacccgaacgggccctacgtccggttcccttcccccgtcggccctaccccctccctacccgaaacgacgaccaccgtcggtcgggggcaccgacggccggcccgtggcctcgccgtggtacaacggcctaacgttccacgtcactcggactcggcgg

SEQ ID NO: 398621 - DNA, 694 bp, Homo sapiens
  misc_feature: GZ8MTXP02HFGW9.38.4.A04.1.454.CMB.2.raw
  modified_base (279)..(279): a, c, t, g, unknown or other
  modified_base (306)..(306): a, c, t, g, unknown or other
  modified_base (317)..(317): a, c, t, g, unknown or other
  modified_base (362)..(362): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtcgtggggggaggtcgttgggtccgacgggcccgggggggtccctggacgtacctctccgtgtgcagcctntgctatcacctttagtaactatttaangagctggtccncagcctccgagggagggctggagtgggtgcagcaattaaccaganaggactaagaaaaatctagtgtaggctctggtacggaacggggtcctaagtttccgaccagtcctcccgaagaacgaaccgaaccgaaccaaaggtaaaccctacaaccgttagtacggcccgttagacccgaacgttagacggaaaccgggttcccgtaagggaacggacgggaccggtaacgggacccgacgggggtaacccttgggttaaacgttaccgtttccgttggttaccggaccgggtaacggaaccccgacccccccgttaagtaaccggggaacgggtaccgtacggaaccgggttaggggacgttaaccgtttaaacccgg

SEQ ID NO: 398622 - DNA, 754 bp, Homo sapiens
  misc_feature: GZ8MTXP02ITB4I.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaggtgtccagtgtgaggtgcaacgtggtggagtcgtgggggaggcttggtccgagggcccgggggggtccctggacgacctctccgtgtgcagcctctgctattctactttagtaacttattaatgagcgtcggtccgccacgcctccggaggggacgggcgtggaggtggggtcggccagtactaacttaaaccgaagagtacggaaccgaacgaaaaattactagtggtacggtactcgtagtacgggaacgggtcccgtacgttccgactactacctaccgaaggacgaaaccgaacccgtaacccgaaaacgtaaaccctaccgtaacgttcgggtacgggtccttacgaacccgaacgtaacgttacgggaacccgggtacgtacggggaagggaacgggaccggaaccggaacggtacccgggtacgtttacgggtaccggtttaaccgtttcggttacgggttaccgtaccgggaaaccggaccccggtaccccccgtaaggtaccggggtaacggggtaacccgtaacggggtacgggtacgggggtaccgtaccggttaaacggtttaacccgg

SEQ ID NO: 398623 - DNA, 606 bp, Homo sapiens
  misc_feature: GZ8MTXP02FKW5H.38.4.A04.1.454.CMB.2.raw
  modified_base (266)..(266): a, c, t, g, unknown or other
  modified_base (317)..(317): a, c, t, g, unknown or other
  modified_base (399)..(399): a, c, t, g, unknown or other
  modified_base (430)..(430): a, c, t, g, unknown or other
  modified_base (435)..(435): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcttgggtccgagggcccgggggggtccctggagactctcctgtgcagcctntgctattctaccttttaagtaaacttatttaaatgagtcgtcggggtcccnccacgccctccggaaggggaaggggctggggaggtggggtcgccagcaaattaaccaagatggaacctagaaaaatctatgnggactcgtgtaggaagggccattcgccatcncaganaacaacgacaaagactcactgtagctgacacagtacgaaaccggccgtaggacggacgggaccggaacgacgacggtcgtggtcgttaacttcgtggtacggcgaacggaccgacccccgagtacgggaacgggacctaacggacggtggggacgtacgtaacggtttacg

SEQ ID NO: 398624 - DNA, 597 bp, Homo sapiens
  misc_feature: GZ8MTXP02FJFOC.38.4.A04.1.454.CMB.2.raw
  modified_base (327)..(327): a, c, t, g, unknown or other
  modified_base (364)..(364): a, c, t, g, unknown or other
  modified_base (414)..(414): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaagggctggagtgggtggccagcattaaccaagatggacgtagaaaaatactatgtggactctgtgaaggccgattcgccatctccagagacaacgcaagactcactgtggctgcacatgaacgctgagaggcgacgacacggctgtgtacttcngtgcgagacgcccccatgacgggctacgaggtggganctacgactttgactacgtgggggccagggaaccctggtccaccgtctccncacgccctccaacccgaacgggccccacgtccggtcccttcccccgtcggccctacccctccctacccaaacgacgacacccgtcgtcgggggaccacgacggcccggcccgtcggggcctcggccgtcgggtaccaagggtaccttaaccgttcccgaacgtcgactcggaacgtcggacgg

SEQ ID NO: 398625 - DNA, 707 bp, Homo sapiens
  misc_feature: GZ8MTXP02HA9Y1.38.4.A04.1.454.CMB.2.raw
  modified_base (305)..(305): a, c, t, g, unknown or other
  modified_base (319)..(319): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggagtcttgggtccgagggcccgggggggtccctggacgacctctccgtgtgcacgtcctctgctattcctacctttagtaacttatttaangagcgtcggtcccncacgtccgtcggaaggggaggggctgggaggtggggtcggaccagactaaacttaaaccgaaagtagtacgggtaacgtaaagaaaaaacttcgtagttggtacgggtacttcgtagggttacgggaaacggggtccccgtaatttcccggaccctacgttacctacccgaaggaacgaaccgaaaccgaccgaaaacgtaacctaccgtaacgttcggtgtaccgtacggaccaacgacgtaacgggaacccggaccgttaggaacgggacggaccggaaccggtacgaaccggggtcttaggttacgttacgtttccgtggtacggacgacgaccccgcccccgtaagcggtacggacctacggagggtacggacggtactaccgg

SEQ ID NO: 398626 - DNA, 583 bp, Homo sapiens
  misc_feature: GZ8MTXP02FF04R.38.4.A04.1.454.CMB.2.raw
  modified_base (265)..(265): a, c, t, g, unknown or other
  modified_base (287)..(287): a, c, t, g, unknown or other
  modified_base (304)..(304): a, c, t, g, unknown or other
  modified_base (401)..(401): a, c, t, g, unknown or other
  modified_base (459)..(459): a, c, t, g, unknown or other
  modified_base (521)..(521): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttcctgttgctattttagaaggtgtccagtgtgaggtgcaacgtggtggagtcgtgggggtaggcttggtccgagggccgggggggttccctggacgactctcctgtgcagcctngcattcaacctttagtaaactnttaatgagctgggtccncagcctcgagggaacggggctgggagtgggtcggccctaggctaaattaaacccgaagtacgtaggaccgtagtaaaaactctagtgtcggacttcnggtgaaggggccattcgccatctccaagacacaacgtcaagaactcaactgcggtccngcacgataggaacccggtcgagacggacggacgaacgacgtacggctggtacgtactttcgngtcgacgacgacccgccccgagtcggaacggcgtacggacggtacggacgtacgtacgtacg

SEQ ID NO: 398627 - DNA, 567 bp, Homo sapiens
  misc_feature: GZ8MTXP02FSMG1.38.4.A04.1.454.CMB.2.raw
  modified_base (257)..(257): a, c, t, g, unknown or other
  modified_base (343)..(343): a, c, t, g, unknown or other
  modified_base (368)..(368): a, c, t, g, unknown or other
  modified_base (410)..(410): a, c, t, g, unknown or other
tcagtcgatcacgtcacgaccggtgctcgatttagagtagtgatcagggggaagaccgatgggcccttgggggaggcttggtccagccgggggggtccctgagactctcctgtgaagcctctgcattcacctttagtaactatttaatgagctgggtccgccagcctccagggagggctggagtgggtggccagcattaaccaagatggacgtagaaaaaatctatgtggactctgtgaagggccgattcgccatcnccagagacaacgccaaagaactcactgtggctgcacatgaacggcctgagaggcgacgacacggctgtgtacttctgtgcgagacncccccatgagggctacgagtggganctgacttgactacgtggggccagggaccctggtcacccgtcncctcagccctccaccaacgggcccagtccgttccttccccctggcccacccctcctaccaaagcgccaccgtcgtgggggccagacgccggcccgtggggctcggccgtggtacaaacggccttaacgtccacggtgactacgactggacgccgggg

SEQ ID NO: 398628 - DNA, 680 bp, Homo sapiens
  misc_feature: GZ8MTXP02HYZBD.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaaatctatgtggactctgtgaagggccgattcgccatctcagagacaacgcaagaactcactgtggctgcacatcgaacggcctgaggacggcgacgacacggctgtcgtactttcgtgtggcgagccgcccccagtggacgggctaacgaggtggggactcgttacgtactttcgaccgttacggtcgggggacctaaccggggtaacccgtggtacccgtaccgtcctcccgtcgacgtccctaccaacccgaacggggcccctaacgttcccggttcccttcccccgtcggtaccctacccccgttaccctacccgaaacgcgtacccgtacccgtcggtccgggggacaaccggacggcccggtccccggtcggggccctcggtacccgttcgggtaccgaaacggtaccttaaccgttcccgacgttacgacgttaccgaacgttcggaccgggg

SEQ ID NO: 398629 - DNA, 563 bp, Homo sapiens
  misc_feature: GZ8MTXP02H7PGY.38.4.A04.1.454.CMB.2.raw
  modified_base (288)..(288): a, c, t, g, unknown or other
  modified_base (363)..(363): a, c, t, g, unknown or other
  modified_base (410)..(410): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtgaaggccattcgccatctcagagacaacgccaaagactcactgtgctgcanatgaacgctgagaggcgacgacacggctgtgtacttcgtgtgcgagacgcccccatggaggctacgaggtggganctacgactttgactacgcggggaccacgggaaccctggctaccgtcnccctcacgcctaccaccgaacgggcccagtccggtccttacccccgtgcctaccctcctaccgaagacgcctaccgtcgtcggggcacgtacggccgccgtggctcggactcgtacgacgtactaaccgtccgagtcgacgcgtacgcgcggg

SEQ ID NO: 398630 - DNA, 578 bp, Homo sapiens
  misc_feature: GZ8MTXP02H9JCV.38.4.A04.1.454.CMB.2.raw
  modified_base (307)..(307): a, c, t, g, unknown or other
  modified_base (360)..(360): a, c, t, g, unknown or other
  modified_base (368)..(368): a, c, t, g, unknown or other
  modified_base (485)..(485): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaaccaagatggacgtgaaaaatctatgtggactctgtgaagggccgattcgccatctccagagacaacgccaaagactcactgtggctgcacatgaacggcctgagnggcgacgacacggctgtgtacttctgtgcgagacgcccccagtgagggctacnggtggganctacgctttgactacgtgggggccagggaaccctggtccaccgtctccctcacgccctccaccgaacgggcccagtccggtcccttcccccgtcggccacccctcctaccaacgacnccaccgtcgtcgggggccacgcggccggcccgtgggcctacgccgtcggtaccaacggtacctaaccgttccgacgtcgactcgactggacgg

SEQ ID NO: 398631 - DNA, 541 bp, Homo sapiens
  misc_feature: GZ8MTXP02GNW5U.38.4.A04.1.454.CMB.2.raw
  modified_base (265)..(265): a, c, t, g, unknown or other
  modified_base (434)..(434): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccgaggggccgggggggtccctggagactctcctgtgcagcctntgcattcacctttagtaactatttaatgagctgggtcccgccagccctccgaggggaggggctggagtgggtggccagcaattaaccaagatggaccgtagaaaaatactatgtaggactcgtgtggaagggccattcgccatctcagagacacgccaagactcactgngctgcacatgaacgctagagaggcgacgacacggctgtcgtacttctgtcgcggagaccgcccccgaagtcggaagggctaacgaggtgggaacgtcgtacgttacg

SEQ ID NO: 398632 - DNA, 667 bp, Homo sapiens
  misc_feature: GZ8MTXP02JOHPF.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggcgttggtccgagggcccgggggggtccctggagacttctcctgtgcagcctctgcattcacctttagtaactatttaatgagtcgtcgggtccgccagccctaccggaggggaacggggctggggagtggggtcggacccagcaattaaaccgaagagtaggaccgtagaaaaatactatggtaggactcgtggtaggacggggtccgtaagtttccggacctaactccgtacccgaaggaacgaacgaacccggacccaaaacgtaacccgtactaacgtggtcggtctaggaccaactagtacggaacccgggtcctaggaacgagggccgaaccggacgacggtcgttcgtcgtaccgtttcgtggtcggacggtacggaccgtcccccgacgtacgggaacgggtaccctaacggtaggtagggacgtaccgtaccgtttaaccgg

SEQ ID NO: 398633 - DNA, 535 bp, Homo sapiens
  misc_feature: GZ8MTXP02FKZYU.38.4.A04.1.454.CMB.2.raw
  modified_base (302)..(302): a, c, t, g, unknown or other
  modified_base (523)..(523): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcttggtccaggcccggggggtccctggagactctcctgtgcagcctctgcattcaccctttagtaactatttaatgagctgggtccncagcctccgagggaggggctggagtggggtgccagcattaaaccagatggaccgtagaaaaatctatgtggactcgtgtgaaaggggccattcgccatctcagagacaacgcaaagactcactgagctggcacatgaacggctgacgaggcgacgacaggctagtgtacttctgtcgcgacgacgcccccagtcggaacgggacttacgaggtggggaacncgtaacgtaacg

SEQ ID NO: 398634 - DNA, 569 bp, Homo sapiens
  misc_feature: GZ8MTXP02IBTDI.38.4.A04.1.454.CMB.2.raw
  modified_base (258)..(258): a, c, t, g, unknown or other
  modified_base (360)..(360): a, c, t, g, unknown or other
  modified_base (368)..(368): a, c, t, g, unknown or other
  modified_base (462)..(462): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccaggggaaggggctggagtgggtggccagcattaaaccaagatggacgtagaaaaatctatgtggactctgtgaagggccattcgcatcncagagacaacgcaagaactcactgtgctgcacatgaacgcctgagaggcgacgacacggctgtcgtacttcgtgtgcgagacgcccccagtggaggctacgnggtggganctacgactttgactcggtggggccaagggaaccctggtcctaccgtctcctcacgccctacaaccgaacgggcccacgtccgtcccttccccgnggcccaccctcctaccaaagcgaccaccgtcgtggggaccacgacgccgccgtgggctcgcgtcggtacaacggtacctcttccgacgtcgactccgacgtcgacgg

SEQ ID NO: 398635 - DNA, 558 bp, Homo sapiens
  misc_feature: GZ8MTXP02I0X12.38.4.A04.1.454.CMB.2.raw
  modified_base (291)..(291): a, c, t, g, unknown or other
  modified_base (303)..(303): a, c, t, g, unknown or other
  modified_base (441)..(441): a, c, t, g, unknown or other
  modified_base (448)..(448): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattgggctgagcttgggttttccttgttgctattttagaaggtgtccagtgtgaggtgcaactggtggagtcgtgggggaggcttggtccgagggcccgggggggtccctggagactctcctgtgcagcctctgcattcacctttagtaactatttaangagctgggtccnccagcctccgagggaagggctaggagtgggtggccagcaattaaccaagactaggaccgtagaaaaatctaatgtaggactcgtgtagaagggccattcgacctatctcagacgaacaacgaccaaagacctcactgngctgcanatgaacgctagacgaggcgacggacacgggtctagtgtacttcgtggtcgacgaacgaccgacccccagtacggaacgggctaacgaggtcggaacgcgtaacgttaacg

SEQ ID NO: 398636 - DNA, 528 bp, Homo sapiens
  misc_feature: GZ8MTXP02HKZ19.38.4.A04.1.454.CMB.2.raw
  modified_base (298)..(298): a, c, t, g, unknown or other
  modified_base (327)..(327): a, c, t, g, unknown or other
  modified_base (419)..(419): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactatttaatgagctgggtccnccagcctccgagggagggctggagtgggngccagcattaaccagatggaccgtagaaaatctaatgtagactctgtgaaggcctatcgctatctcagagacaacgccaaagactcacgtgngctgacacatgaacggctagagaggcgacgacacggctgtcgtacttcgtgtcgcgacgccgacccccgagtcggaacggctaacgaggtacgggacgcgttacgtacg

SEQ ID NO: 398637 - DNA, 550 bp, Homo sapiens
  misc_feature: GZ8MTXP02JNQAP.38.4.A04.1.454.CMB.2.raw
  modified_base (302)..(302): a, c, t, g, unknown or other
  modified_base (347)..(347): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggccgggggggtccctggagactctcctgtgcagcctctgcattcacctttagtaacttatttaatgagctgggtccnccagcctccgagggagggctggagtgggtgccagcattaaccagntaggaccgtagaaaatctagtgtggactctggtaggaagggtccgattcgccatcctccagacgacaacgaccaagaacctcaactgtagctggcacatcggaacggccgtgacggaggacgacgacgacggctgtgttacttcgtggtcgcggacgccgcccccgagtggaacggctacgagggtggaacgcgtacgttacg

SEQ ID NO: 398638 - DNA, 610 bp, Homo sapiens
  misc_feature: GZ8MTXP02G9RQ7.38.4.A04.1.454.CMB.2.raw
  modified_base (271)..(271): a, c, t, g, unknown or other
  modified_base (374)..(374): a, c, t, g, unknown or other
tcagtcgatcacgtcacgaccggtgctcgatttagagtagtgatcagggggagtcagtcccagtcaggacacagcatgggacatgagggtccccgctcagctcctggggctcctgctgctctggctcccaggtgccggatgtgacatccagttggcccagtctccatccttcctgtctgcatctggtaggggacagagtcaccatcacttgccgggcagtcagggcattaggactcgttagcctggtatcagacaaaaaccgagggaaacncccctaactcctgatctatggtcgctatcctatttgacgtaaaggtcgggtcccatcgaaggttcaggtcgacaggtgatcgtagggacagtattcagtctanacaatcaagcagccctagccagcccgtgacgatacgtagactaaactttattattacgtactaactagttactttaaataacccgttacccccaagttacccgttttacgggacccgtaagggggtaaaccctaaaggtttacggggaaactaacgttaaaccgaaaaacggtacgttgggtacggcttaacggcctaaccgtattccgtaacgttcctttacgaacttttccccg

SEQ ID NO: 398639 - DNA, 619 bp, Homo sapiens
  misc_feature: GZ8MTXP02IXM95.38.4.A04.1.454.CMB.2.raw
  modified_base (306)..(306): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagactcactgtggctgcacatgaacggcctgagnggcgacgacacggctgtgtacttctgtgcgagacgcccccactgagggctacgaggtgggagctacgtactttgacctacgtcgggggccagggtaccctggtccaccgtctccctcacgtcccttcaccgaacgggcccagtccggtccctttcccccgtcggtcccacccccgttcctacccgaaacgcgaccaccctcggtcgggggaccacgacggcccggccccgtggggcctcggcccgtcggggtaccaaacggtaccttaacccgttacccgacggtacgaacgttccggacgttcggaacgggg

SEQ ID NO: 398640 - DNA, 571 bp, Homo sapiens
  misc_feature: GZ8MTXP02IYUR7.38.4.A04.1.454.CMB.2.raw
  modified_base (363)..(363): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacgcctgagaggcgacgacacggctgtgtacttctgtgcgagcgcccccatgaggctacgagtgggancgtacgactttgactacgtggggccaagggaaccctggtcaccgtctcccgtcacgccctccaccgaacgggcccagtccggtccttcccccgtcggtccacccctcctacccaacgacgaccacctcgtcgggggcaacgcgccggcccgtgggctcgcctcggtacgaacggactaacgttccgacgtcgaactcgactacggcgg

SEQ ID NO: 398641 - DNA, 573 bp, Homo sapiens
  misc_feature: GZ8MTXP02JEYXY.38.4.A04.1.454.CMB.2.raw
  modified_base (499)..(499): a, c, t, g, unknown or other
  modified_base (513)..(513): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtggggggaggcttgggtccgaggcccgggggggtccctggagactctcctgtgcagcctctgcattcacctttagtaactattaatgagcgtgggtccgccagcctccgaggggaagggctggagtgggtggccagcattaaaccagatggaaccgtagaaaaatctatgtggactcgtgtgaaacgggccgaattccggacctaatccctacccaggacgacaaaccggaccaaagacctcaacgtgcggctgcacgatgaaccggccagacggaggcgaacgcgaccgggttntagtcgttactcgngcgacggacgacccgccccgaggcggaacggcgtagacggtacggacgtacgtaacgtcg

SEQ ID NO: 398642 - DNA, 550 bp, Homo sapiens
  misc_feature: GZ8MTXP02IQ21B.38.4.A04.1.454.CMB.2.raw
  modified_base (287)..(287): a, c, t, g, unknown or other
  modified_base (300)..(300): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactatttaangagctgggtcccnccagcctccgaggggaggggctggagtgggtgcccagcattaaccagatggaccgtagaaaatctatgtggactcgtgtggaagggccattcgccatctcagacgaacaacgaccaaagacctacacgtgtaggctagcacatcgaaccggctagaggaggcgacggacgacggtctgtcgttacgttcgtgtgacggacgaccgcccccgagtggaacgggacctacgaggtcggacgcgtacgttacg

SEQ ID NO: 398643 - DNA, 704 bp, Homo sapiens
  misc_feature: GZ8MTXP02ITUPC.38.4.A04.1.454.CMB.2.raw
  modified_base (237)..(237): a, c, t, g, unknown or other
  modified_base (265)..(265): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaaccaagatggacgtagaaaaatctatgtggactntgtagaaggccgattcgccatctcaganacaacgcaagaactcactgtgctgcacatgaacgctgagaggcgacgacgacggctgtcgttacttcgtgtcgacgagaccgccccctagtggacgggacctagaggtgggactcgttacgtctttagaccgttacgggtcgggggaccgaacgggaacccgttcggtacccgtacccgttcctccctacgacccgtccctaccccgaacccgaaccgggtcccctaacgttccccggttcccttcccccgtccggtccccgtaccccctccgtaacccgaacgaccgccgtaacccgtcgggtccgggggaccaccggaccgggcccggtcccgggtcggggtccctcgggtacccggttacgggtaaccgtaaacggtacccttaaccgttcccgtaacggttacggtaccgtacggtaaccgtcggggaaccgggg

SEQ ID NO: 398644 - DNA, 638 bp, Homo sapiens
  misc_feature: GZ8MTXP02G84MQ.38.4.A04.1.454.CMB.2.raw
  modified_base (289)..(289): a, c, t, g, unknown or other
  modified_base (302)..(302): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccagggccggggggtccctggagactctcctgtgcagcctctgcattcacctttagtaacttatttaangagcgtgggtccnccagccctccgaggggagggctggaggtggggtgccaggcaattaaaccaagagtggaaccgtaagaaaaaattctaagtggtaggacttcgtgtacgggaaacgggcccgtaagttccgacctacttccctaccgaaagacgaaccgaaaccgaacccaaagaacctcaacgttggacggctacgacacgagttacggaaccggccgtaggaacgagggacgaacgacgacggcgtaggtcgttacgttcgtaggtcgacggaacggcccgacccccgtaagtcgggaacgggtcctaacggaggttacggggacgtaccgttaaccgtttaccg

SEQ ID NO: 398645 - DNA, 528 bp, Homo sapiens
  misc_feature: GZ8MTXP02GUBF9.38.4.A04.1.454.CMB.2.raw
  modified_base (305)..(305): a, c, t, g, unknown or other
  modified_base (431)..(431): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggaggcttgggtccgagggcccgggggggtccctggagactctcctgtgcagcctctgcattcacctttagtaactatttaatgagctgggtccnccagccctccgaggggagggctggagtgggtgccagcattaaaccagatggacgtagaaaatctatgtgactgtgtgacgggccattcgcatctccagagacaacgcaagactcactgagctgcanagtgaacggctagagaggcgacgacgacggctgtgtacttcgtgtcgcgacgccgacccccagtcggaacggcacgaggtgggactcgtacgttacg

SEQ ID NO: 398646 - DNA, 619 bp, Homo sapiens
  misc_feature: GZ8MTXP02HZ09B.38.4.A04.1.454.CMB.2.raw
  modified_base (240)..(240): a, c, t, g, unknown or other
  modified_base (364)..(364): a, c, t, g, unknown or other
  modified_base (372)..(372): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgaggggaaggggctggagtgggtggccagcattaaccaagatggacgtagaaaaatctatgtggactctgngaagggccattcgccatctcagagacaacgcaagactcactgtgctgcacatcgaacgcctggagaggcgacgacgacggctgtgtacttcgtgtgcgacgcgccccagtggacgggctaacgnggtgggancgtacgtactttgacgttacgtcggggaccacgggacccgtgtccgaccgtctccctcacgccctccgaaccgaaccgggcctacgtccggttcccttccccgtcggccctacccctcctaccgaaacgccgcctaccgtcggacgggggccaacgcggtcccggtcccggtacgggcctcggaccgttcgggacctaacggtaccttaaccgttcccgaagttcgacgtccggacgttggccgggg

SEQ ID NO: 398647 - DNA, 552 bp, Homo sapiens
  misc_feature: GZ8MTXP02IFUUV.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatcctccctgtctgcatctgtaggagacagagtcaccatcacttgccgggccagtcagggcattagctagttattagcctggtatcaagacaaaaccgaggaaacgcccctaagctcctgatctatgctcgcctcctactttgactaaaggtcggggtacccagtacgtaaggttccagcggcaggtcgatcgtggggacagtactttcacttcacaccatcagcacgccctgccagtcctagtaagtatttagacttaaacttattactgtaaccaagtacgtactttaaagttattactcttcgtacgtttcgggacggtaacgggacgaaggtcgaagtactaacgaaaacgtacgtgtaaggctagacctacattctcgtttac

SEQ ID NO: 398648 - DNA, 711 bp, Homo sapiens
  misc_feature: GZ8MTXP02G23ZW.38.4.A04.1.454.CMB.2.raw
  modified_base (292)..(292): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtgaagggccattcgccatctccagagacaacgcaagactcactgtggctgacanagtacggaaccgctaggaggacggacgaacgacgacggtctgtaaagttccttcgtggcgacgacgacccgaccccagtgggacggtactacggtagggtggggactccgttaaccgttacgtttacggaaccgttacggggcgggggacccgtaaaccgggggtaaccccgttgggtaccctacccgttcctccctaccgaccgtacccctacccgaaacccggaccgggaccccctaggttccccggttccccctttcccccgcggaccccctaccccctcctaacccgaaacgccgacccgtaccgtccggggcgggaccacgtccgggcccggccggtcgggtacctcggaccgttcggtaaccgaacggtaccttaaccgtcccgtaacgtacgactaccggtcggtacggcgg

SEQ ID NO: 398649 - DNA, 916 bp, Homo sapiens
  misc_feature: GZ8MTXP02JMF7X.38.4.A04.1.454.CMB.2.raw
  modified_base (269)..(269): a, c, t, g, unknown or other
  modified_base (310)..(310): a, c, t, g, unknown or other
  modified_base (328)..(328): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagtcgttgggtttttccttgttgcttattttagaaggtgtccagtgtgaggtgcaacgtggtggagtcggtgggggagtcgttggccgacggggcccgggggggtccctggagcctctccgtgtgcncgcctctgctacttcctaaccttttagtaaacttatttaanggacgtcgtcgggtcccnccaggtcccctaccgggaagggggacgggcgtaggggagggttggggcggacccaggactaaacgttaaaaccgaaggtagtacgggaacgtaaaggtaaaaattactagttaggtacggtactttcggtagggttacgggaaaccggggtccgtactttacccggacccttacgtaccctaccgaaaggaaaccgaaacccgaaaccgaaaccccgaaaacgtaacccgtaaccgtaccgttagggtacggtccgtacggtaacctaaccggtaacggtaacggggtaaacccccgggtaccgggtaaaggggaaacgggaaccgggggtaaacccgggaacccgggaaaccccggaacccggggtttcgtttaaaccggggttaccgggtttttaaaccccgtttccggggttacggttacccgggggaacccggttaaacccgggtaaccccccggggacccccccccggtttaaagggtaccgggggaaacccgggggttaacccggtaaacccggggttaagggggttacccgggggtaaaaccggttaaccccggggtttaaaccggttttaaaccccgggg

SEQ ID NO: 398650 - DNA, 658 bp, Homo sapiens
  misc_feature: GZ8MTXP02HS66V.38.4.A04.1.454.CMB.2.raw
  modified_base (304)..(304): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttggtccgaggccgggggggtcctggagactctcctgtgcagcctctgctattcacctttagtaactatttaatgagcgtcgggtccnccagccctaccggaggggaaggggctgggagtggggtcggccaggactaattaaaccgaagtagtaggaaccgtaagaaaaaacttcgtaagtggtagggacttcgtagggtaggaaacgggcccgtattccggacctactccgtaccaggaacgaaccaacggacccaaaagaacctccgaacgtggtcgggctacggacaacgagttacgggaaccggtccgtagggaacggacggggaccggaaccggtaacgaaccgggtcttacgggttcgttacgtttccgtggtacgacggacggacccgcccccaagtcgggaacggctaacggaggtgggactcgttacgttacg

SEQ ID NO: 398651 - DNA, 565 bp, Homo sapiens
  misc_feature: GZ8MTXP02HXY6M.38.4.A04.1.454.CMB.2.raw
  modified_base (291)..(291): a, c, t, g, unknown or other
  modified_base (303)..(303): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcttggtccgagggccggggggtcctggagactctcctgtgcggcctctgcattcacctttagtaacttatttaangagctgggtccncagcctcgaggggagggctgggagtgggtggccagcaattaaaccaagataggactagaaaaaatctatgtagactctgtgaaggccattcgccatctccagacgacaacgcaaagaactcaatgtgctgacacatacggaacgtcctagaggaggcgacgacgacggctgtgtaccttcgtagtgcgacgtaccgacccccacgtacggacgggaaccgttacgagggttacggggacgtacgtaacgttacgtttaacgg

SEQ ID NO: 398652 - DNA, 572 bp, Homo sapiens
  misc_feature: GZ8MTXP02JXZQ6.38.4.A04.1.454.CMB.2.raw
  modified_base (301)..(301): a, c, t, g, unknown or other
  modified_base (352)..(352): a, c, t, g, unknown or other
  modified_base (360)..(360): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaaggccgattcgccatctcagagacaacgcaagactcactgtggctgcacatgaacgctgagnggcgagcacggctgtgtacttctgtgcgagccgccccagtgaggctaacgnggtggganctacgattttcgactacggtggggacccagggaacccgtggtccaccgtctcctcacgcctccaccgaacggcccacgtccggtcccttccccgtcggccaccctccgtaccaacgacgcctaccgtcgtcgggggccacgcggccggcccgtggctcgccgtcggtaccgaacggtactaacttccgaacgtcgacgtcgtacgcgacggg

SEQ ID NO: 398653 - DNA, 601 bp, Homo sapiens
  misc_feature: GZ8MTXP02IC6TQ.38.4.A04.1.454.CMB.2.raw
  modified_base (294)..(294): a, c, t, g, unknown or other
  modified_base (306)..(306): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagtcttgggttttccttgttgcttattttagaaggtgtcagtgtgaggtgcacgtgggtggagtcgtgggggagtcttggtccgagggcccggggggtcctggacgtactctcctgtgcagcctctgctattcacctttagtaactattaangagcgtggtccnccagccctaccgaggggaagggctgggagtggggtcgcagacaagttaaaccaagtagtaggacccgtaagaaaaaatcagtgtcggaacttcgtggtacgaaacggggtcctagttccgacctatccctaccagacgaacaaacgaccaaagacttcacgtgtgactgacacgaatcggaaaccggctaggaggaacggcgtacgacgtacggtcgtgtcgttaccttgtgtacgcggacgacccgcccctagcggaacggtacctaggaggttaggacgtactacgtttaacg

SEQ ID NO: 398654 - DNA, 631 bp, Homo sapiens
  misc_feature: GZ8MTXP02JCYKN.38.4.A04.1.454.CMB.2.raw
  modified_base (305)..(305): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttccttgttgctattttagaaggtgtccagtgtgaggtgcaactggtggagtcgtgggggaggcttgggtccgagggccgggggggtccctggagacctctcctgtgcagcctctgctattctaccttagtaacttattaatgagcgtgggtccnccagcctccgaaggggaaggggctgggagtggggtggaccgagctaataaaccgaagagtaggaaccgtagaaaaaatactatgtaggtactcgtgtaggaacgggccgtaattccgacctatccctaccgaagaacgaaccaacgaccaaaagaacctactaactggtacggctcgacacagtacggaaccggtccgaggaaaggaggaccggaacggaacgacgggcgtgttaacggtaccttgtaggtcggaccgaaaggtacccgccccctagtagggaacggtcctaacggagggtacgggacgtaccgtaacgttaaccg

SEQ ID NO: 398655 - DNA, 602 bp, Homo sapiens
  misc_feature: GZ8MTXP02I1DQD.38.4.A04.1.454.CMB.2.raw
  modified_base (374)..(374): a, c, t, g, unknown or other
  modified_base (524)..(524): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccagggaaggggctggagtgggtggccagcattaaaccaagatggacgtagaaaaatctatgtggactctgtgaaggccgattcgccatctcagagacaacgccaagaactcactgtggctgcacatcgaacggcctgagaggcgacgacgacggctgtgtacttcgtgtgcgagaccgccccagtgacggctacgaggtgggacncgtacgactttgacctacgtggggcctacgggaacccgtgtccaccgtcctcctacgacgccctaccaccgaacggccctactccggttccctcccccgtcggccctaccccctccgtacccgaaagtccaccgacctcggtcggggacncgacggccggtcccgtggccgttcgcctcggtaccaacggtaccttaacgtccgacgttcgacgtcgacgtagacggg

SEQ ID NO: 398656 - DNA, 547 bp, Homo sapiens
  misc_feature: GZ8MTXP02JW8P3.38.4.A04.1.454.CMB.2.raw
  modified_base (298)..(298): a, c, t, g, unknown or other
  modified_base (438)..(438): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctcctgtgcagcctctgcattcacctttagtaactattaatgagctgggtccnccagcctccgagggaggggctggagtggggtcgccagcattaaaccagatggaccgtagaaaaatactatgtaggactgtgtaggaacgggcgtatcgccatcctccagagacaacgcccaaagactcactgtgctgcanatagaacggcctagagacggcgacgacgacggctgtagtacttctggtcgacgacgaccgcccccgacgtcggaacgggctaaccgaggtcgggacgaccgtacgtacg

SEQ ID NO: 398657 - DNA, 602 bp, Homo sapiens
  misc_feature: GZ8MTXP02FT9KN.38.4.A04.1.454.CMB.2.raw
  modified_base (213)..(213): a, c, t, g, unknown or other
  modified_base (235)..(235): a, c, t, g, unknown or other
  modified_base (323)..(323): a, c, t, g, unknown or other
  modified_base (364)..(364): a, c, t, g, unknown or other
  modified_base (370)..(370): a, c, t, g, unknown or other
  modified_base (601)..(601): a, c, t, g, unknown or other
tcagtcgatcacgtcacgaccggtgctcgatttagagtagtgatcaggggggtccctgagactctcctgtgcagcctctgcattcacctttagtaactatttaatgagctgggtccgccagcctccagggaagggctggagtgggtggccagcattaaccaagatggacgtagaaaaatctatgtggactctgtgaagggccattcgccatcnccagagacaacgccaaagactnactgtggctgcacatgaacggctgagaggcgacgacacggctgtgtacttctgtgcgagacgcccccatgagggctacgaggtggganctagactttgaccctacgtggggcacgggaaccctggtccncccgtntccctcacgccctcccgaccgaacgggcccagtcccggtccttcccccgtggcccacccctcctccaagcgccacctcgtacgggggccacgacggccggcccgtgggcctcgccgtgggtacaaacggtaccttaccgttacccacggtttcgaaacgttcccgaacgttcggacgggtccggggacgttcggggaacccgaaacggggtccgaccggtaagtacgcgcng

SEQ ID NO: 398658 - DNA, 542 bp, Homo sapiens
  misc_feature: GZ8MTXP02FEKK7.38.4.A04.1.454.CMB.2.raw
  modified_base (333)..(333): a, c, t, g, unknown or other
  modified_base (363)..(363): a, c, t, g, unknown or other
  modified_base (371)..(371): a, c, t, g, unknown or other
  modified_base (377)..(377): a, c, t, g, unknown or other
  modified_base (388)..(388): a, c, t, g, unknown or other
  modified_base (412)..(412): a, c, t, g, unknown or other
  modified_base (497)..(497): a, c, t, g, unknown or other
  modified_base (538)..(538): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccagggaaggggctggagtgggtggccagcattaaccaagatggactgaaaaatctatgtggactctgtgaagggccattcgccatctccagagacaacgccaagactcactgtggctgcacatgaacggcctggagaggcaacgtacacggctggtatacttcnggtgcgagacgcccccatggaggctaacgnggtggganctacgntttgactacgnggggccaggaccctgtcaccgtcncctcacgcctccaccaggcccagtcgtcctcccctcgccaccctcctaccaacgacgcaccgtcgcggggcacgacgccgtccgnggctcgcctcggtcaaggactaacgtcacgtcactcgacgngcgg

SEQ ID NO: 398659 - DNA, 645 bp, Homo sapiens
  misc_feature: GZ8MTXP02JJ6M7.38.4.A04.1.454.CMB.2.raw
  modified_base (362)..(362): a, c, t, g, unknown or other
  modified_base (371)..(371): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtgaaggccattcgccatctccagagacaacgcaagaactcactgtggctgcacatgaacggcctgagaggcgacgacacggctggtgtacttcgtgtgcgagacgcccccagtgagggctacgnggtgggacnctacgactttgacctacgtcgggggaccaggggtaacccgtggtacctacccgtcctcctaccacgtccctaccacccgaaaccgggtccccaacgttcccgggttccccttcccccgtccgggtacccctacccccttccccgtacccgaaacgaccgacctacccgttccggacgggggccaccggacggcccggtcccggtcgggccgtcggcccgtcggtaccgaacggaccttaaccgtaccgacgtacgacgtccgaacgtcggacgg

SEQ ID NO: 398660 - DNA, 578 bp, Homo sapiens
  misc_feature: GZ8MTXP02HLKHS.38.4.A04.1.454.CMB.2.raw
  modified_base (296)..(296): a, c, t, g, unknown or other
  modified_base (310)..(310): a, c, t, g, unknown or other
  modified_base (356)..(356): a, c, t, g, unknown or other
  modified_base (375)..(375): a, c, t, g, unknown or other
  modified_base (382)..(382): a, c, t, g, unknown or other
tcagtcgatcacgtcacgaccggtgctcgatttagagtagtgatcaggggaggtctcagagaggagccttatccctggactccaaggcctttccacttggtgatcagcactgagcacagaggactcaccatggaattggggctgagctgggttttccttgttgcttattttagaaggtgtccagtgtgaggtgcaactggtggagtcgtgggggaggtcgttggtccgagggccggggggtccctggagactctcctgtgcagcctctgctattcacctttagtaacttatttaangtagcgtgggtccnccagcctccgaggggagggctggagtgggtcgcagcattaaccagncggactagaaaatctatgngctgtgngaaggctatcgcatctcagagacaacgaccaagaactcacgtagtgctgacacatacggaacggccgtaggaggaggccggacgaccgaccgggtctcggttacgtacgtttccgtggttcgacggacgacccgaccccccgtaagaaccggacgggtaccgttacggagggttacgggacgtaccgtttaaccgg

SEQ ID NO: 398661 - DNA, 635 bp, Homo sapiens
  misc_feature: GZ8MTXP02GFPY1.38.4.A04.1.454.CMB.2.raw
  modified_base (302)..(302): a, c, t, g, unknown or other
  modified_base (365)..(365): a, c, t, g, unknown or other
  modified_base (463)..(463): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattccacctttagtaactatttaatgagctgggtccgccagcctccagggaagggctggagtgggtggccagcattaaccaagatggacgtagaaaaatctatgtggactctgtgaagggccattcgcatctcagagacaacgcaagaactcactgtggctgcacatgaacgcctgagnggcgacgacacggctgtgtacttctgtgcgagacgcccccagtgaggctacgaggtggggacncgtacgactttgacctacgtgggggccaacgggacccgtggtccaccgtctcctcgacgccctaccaccgaacggacccacgtccggtccttcccccncggtccctacccctccctacccgaaacgacgaccgtacccgtcggtccgggggaccaccggacggcccggggtccccggtcgggggtccgtccgggtcccgtcggggtaacccgtaacgggaaccttaaccgtttacccgacggttacgacgttaccggaactcgggacggg

SEQ ID NO: 398662 - DNA, 606 bp, Homo sapiens
  misc_feature: GZ8MTXP02JAV2M.38.4.A04.1.454.CMB.2.raw
  modified_base (295)..(295): a, c, t, g, unknown or other
  modified_base (309)..(309): a, c, t, g, unknown or other
  modified_base (339)..(339): a, c, t, g, unknown or other
  modified_base (356)..(356): a, c, t, g, unknown or other
  modified_base (497)..(497): a, c, t, g, unknown or other
tcagtcgatcacgtcacgaccggtgctcgatttagagtagtgatcagggggtctcagagaggagccttagccctggactccatggcctttccacttggtgatcagcactgagcacagaggactcaccatggaattggggctgagctgggtttcctgttgctatttagaggtgtccagtgtgaggtgcaacgtgggtggagtcgtgggggaggtcgttggtccgagggtccggggggtccctggagtactctccgtgtgcagcctcgtgctattctacctttagtaactatttaangacgcgtcggtccncacgcctcgaggggaggcgtggaggtgggngccgagctataacaagntacggacgtaagaaaatactagtggtagtacgtcgtggtagggaacgggtccgtaattccggctaaacgtcctaaccgaagaacgaaacgaaccgaccaaagaactcacgtgcggactcgacaactagtcggaaccgtcgngaacggacgggacgtacgaccgacgtcgtacggttcgtacgtttcgaggtccgacggacgaccccgcccctaggcggacggtctacggaggtacggacgtacttaacgg

SEQ ID NO: 398663 - DNA, 553 bp, Homo sapiens
  misc_feature: GZ8MTXP02GRVOU.38.4.A04.1.454.CMB.2.raw
  modified_base (251)..(251): a, c, t, g, unknown or other
  modified_base (283)..(283): a, c, t, g, unknown or other
  modified_base (295)..(295): a, c, t, g, unknown or other
  modified_base (316)..(316): a, c, t, g, unknown or other
  modified_base (336)..(336): a, c, t, g, unknown or other
  modified_base (353)..(353): a, c, t, g, unknown or other
  modified_base (358)..(358): a, c, t, g, unknown or other
  modified_base (381)..(381): a, c, t, g, unknown or other
  modified_base (385)..(385): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattgggctgagctgggttttccttgtgctattttagaggtgtccagtgtgaggtgcaactggtggagtcgtgggggagcgttggtccgaggcccggggggtcctgagctctcctgtgcngcctctgcattcacctttagtaactatttaangagcgtggtccncagccctcgagggaggctggngtggtgccagcataacgagngtggaccgtagaaaatntatgngactgtgtgaggcctagtcgacntccncagacgacaacaccaagactcactgtcgctgcacagtagacggccgtagacgaggacgacgacgacggcgtgtcgttacgttccgtggtcggacggacgtacccgaccccccgagtacgggaacgggttccaacggtaggaggggtacgtaccggtacgtttaaccgg

SEQ ID NO: 398664 - DNA, 584 bp, Homo sapiens
  misc_feature: GZ8MTXP02JUCEE.38.4.A04.1.454.CMB.2.raw
  modified_base (321)..(321): a, c, t, g, unknown or other
  modified_base (361)..(361): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatactatgtggactctgtgaagggccgattcgccatctccagagacaacgccaagactcactgtggctgcacatgaacggcctgagaggcgacgacacggntgtgtacttctgtgcgagacgccccccatgagggctaacnggtggganctacgactttgactacgtggggccaggggaaccctggcacccgtctcctcacgccctccaccgaacgggccccagttcccggtccttccccccgtggccctacccccgtccctacccaagacgaccacccgtcgtcgggggcacgacgccggcccgtgggcctcgcccgtggtaccaacggacttaaccgttccgacgtcgactcgactgacggg

SEQ ID NO: 398665 - DNA, 577 bp, Homo sapiens
  misc_feature: GZ8MTXP02GC34N.38.4.A04.1.454.CMB.2.raw
  modified_base (282)..(282): a, c, t, g, unknown or other
  modified_base (338)..(338): a, c, t, g, unknown or other
  modified_base (365)..(365): a, c, t, g, unknown or other
  modified_base (456)..(456): a, c, t, g, unknown or other
  modified_base (499)..(499): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagactcactgngctgcacatgaacgcctgagaggcgacgacacggctgtgtacttctgtgcgagccncccccagtgagggctacgaggtggganctacgactttgactacgtggggccagggacctggtccacgtctcctcacgccctccgaaccgacgggccctagtccggtcccttcccccgnggcccacccctcctaccaacgcgcctaccgtcggcggggaccncgacggccggcccgtgggcctcgccgtcggtaccgaacggtcctaaccgttccgacgttcgactccgacgtcggacgg

SEQ ID NO: 398666 - DNA, 617 bp, Homo sapiens
  misc_feature: GZ8MTXP02IR8BX.38.4.A04.1.454.CMB.2.raw
  modified_base (313)..(313): a, c, t, g, unknown or other
  modified_base (327)..(327): a, c, t, g, unknown or other
  modified_base (487)..(487): a, c, t, g, unknown or other
  modified_base (527)..(527): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtcggtggggggaggctttgggtccgagggccccggggggggttccctggacgtacctcttcctgtgcagccctctgctattcctaacctttagtaaacttatttaangagcgtgggtcccnccagcctcgaggggagggctggaggtgggtgcccagctaattaaaccagatggaacgtaagaaaaatctagtgtaggacttgtggtaggaaacgggcctagttcgacctatcctaccagacgaacaaccgtaccaaacgacctcacgtgtcgctgaccanagtacggaacccggtcgtaggaggacggcgacgacgcggntcgtacgttcttcgtgtcggacgacgacccgacccccgagtacgggaacggggtacctaggtacgggtagggacgtcgtaacggtttacg

SEQ ID NO: 398667 - DNA, 675 bp, Homo sapiens
  misc_feature: GZ8MTXP02H6KBH.38.4.A04.1.454.CMB.2.raw
  modified_base (303)..(303): a, c, t, g, unknown or other
  modified_base (384)..(384): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgagggcccggggggggtcctggagactctcctgtgcagcctctgcattcaccttagtaactattaatgagtctcgggtccnccagccctcgagggagggctggagtgggtgcagctaataaccgaagagtaggaaccgtaagaaaaatctaatggtagactntagggtagaaacggggcctaagtcgctactcctaccgaagacaaccgaaccgacctaaagaacctccgtaacgtggttcggctacgcctaacgtacgtacggaaacccggttccgaggaacggaccgggaccgaaccggaaacgccggggtacttcgggtaaccgttaccgttcggttacggaccgtaccggtacggaaccccggtaccccccgaaaggttccggggaaccgggttaccgaaccggttaaacggggtcggggaacgtttaccgttaaccggtttaacccgg

SEQ ID NO: 398668 - DNA, 570 bp, Homo sapiens
  misc_feature: GZ8MTXP02ILJTI.38.4.A04.1.454.CMB.2.raw
  modified_base (295)..(295): a, c, t, g, unknown or other
  modified_base (347)..(347): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtgccagcattaaccaagatggacgtgaaaaatctatgtggactctgtgaaggccattcgcatctcagagacaacgcaagactcactgtgctgcacatgacgctgagnggcacgacacggctgtgtacttctgtgcgagacgcccccagtgaggctacgngtgggatctacgtacgtttgactacgtgggggaccacgggtaacccgtgtccgtaccgtcctacctcacgcccctcaacccgaacgggcccacgtccggttcccttcccccgcggccctacccctcctacccaagacgcaccgttcgcggggcacgcgccgccgtgggctcgccgtcggtacgaggtacctaacgtccacgttcgaacgtcgtacgtggacgg

SEQ ID NO: 398669 - DNA, 606 bp, Homo sapiens
  misc_feature: GZ8MTXP02FQ7MI.38.4.A04.1.454.CMB.2.raw
  modified_base (286)..(286): a, c, t, g, unknown or other
  modified_base (320)..(320): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccaggggaaggggctggagtgggtggccagcattaaaccaagatggacgtagaaaaaatactatgtggactctgtgaagggccattcgcatctccagagacaacgccaagactcactgngctgcacatgaacgctgagaggcgacgacacggntgtgtacttctggtgcgagaccgcccccagtggacgggctacgaggtggggactcgtacgtactttgaacctacggtcgggggccaacgggaaccctggtaccaccgtctcctcacgccctaccaccgaacgggcccacgttccggtcccttcccccgcggccctacccctcctacccaaacgacgacctaccgtcggtcgggggccacgacggccggcccgtgggcctacgccgtcggtacgaacggtacctaaccgtccgacgtcgacgtcgacgtcggacggg

SEQ ID NO: 398670 - DNA, 563 bp, Homo sapiens
  misc_feature: GZ8MTXP02JIVLY.38.4.A04.1.454.CMB.2.raw
  modified_base (540)..(540): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttcctgttgctatttagaaggtgtccagtgtgaggtgcaactggtggagtcgtgggggaggcttggtccaggccggggggtccctgagactctcctgtgcagcctctgcattcacctttagtaacttattaatgagctgggtccgccagcctccgagggaggggctggagtgggtgccagcattaaccagatggaccgtagaaaatctaatgtaggactcgtgtggaaacggggcctattcgacctatcctcgagagacaacgacccgtaagaacctcgaactgtcggactgcacagtacgaacggcctaggagacggacgacgacgacggcgtgtcgtacgttctggtacgcgacgccgaccccctagtaggaacggggtctaaccggnggtaggacgtaccgtacgttacg

SEQ ID NO: 398671 - DNA, 600 bp, Homo sapiens
  misc_feature: GZ8MTXP02FYU0Q.38.4.A04.1.454.CMB.2.raw
  modified_base (443)..(443): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcttgggtccgagggcccgggggggtccctggagactctcctgtgcagcctctgctattccaccttttagtaacttattaatgagttcgggtccgccagcctcgaggggagggctgggagtggtcgcagcattaaaccagagtggaacgtagaaaaattctatggtggacttcgtgtggaacgggccgtattccgcctatcctaccgagagaccaacgaccaagaaccncactgtcggctgacacatacggaaccgctaggagacgggccgaacgacgacggtcgtgtacgttacttcgtagtcggacggtacgacccggtacccccagtcgggacgggaaccttacggagggttacggggacgtaccgtacggttaccgtttagg

SEQ ID NO: 398672 - DNA, 762 bp, Homo sapiens
  misc_feature: GZ8MTXP02GCRP9.38.4.A04.1.454.CMB.2.raw
  modified_base (302)..(302): a, c, t, g, unknown or other
  modified_base (313)..(313): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtcgtggggggaggtcgttgggtccgagggcccggggggggtccctggagactctcctgtgcagcctctgctattccacctttagtaacttatttaangagctggtccncagcctcgaggggagggctggaggtgggcgccagctaattaaccgaagagtacggacgtaagaaaaaatctaatggtagacttcgttaggtagggaaacgggggcccgtaagtttcccggacctaacgttcccgtacccgaagaaccgaaaccgaaacccggacccgaaaacgtaacctacgaaccgttgggttacgggaccttcggaaccaaccgaaggttacgggaaaacccgggggtcccttaaggggaaacgggtaaccggggcccgtaaaaccggaaccggtaacccgggggtctttaacggggtttccgtttaaaccgttttccgtagggttccgggacccgggaacgaacccccgggcccccccctaaaacgggtggggtaaaccggggtacccgttaaaccggagggggtttacgggaaccgttacccgtttaaaacccgg

SEQ ID NO: 398673 - DNA, 546 bp, Homo sapiens
  misc_feature: GZ8MTXP02GPTXM.38.4.A04.1.454.CMB.2.raw
  modified_base (260)..(260): a, c, t, g, unknown or other
  modified_base (301)..(301): a, c, t, g, unknown or other
  modified_base (332)..(332): a, c, t, g, unknown or other
  modified_base (348)..(348): a, c, t, g, unknown or other
  modified_base (363)..(363): a, c, t, g, unknown or other
  modified_base (368)..(368): a, c, t, g, unknown or other
  modified_base (377)..(377): a, c, t, g, unknown or other
  modified_base (422)..(422): a, c, t, g, unknown or other
  modified_base (504)..(504): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggcccgggggggtcctggagactctcctgtgcagcctntgctattcacctttagtaacttatttaatgagctgggtccnccagccctccgagggaggggctggagtgggngccagcattaaccgantggacgtagaaaatntatgngactcgtgngaagggccattcgcatctcagagacacgaccaagactcacgtagngctgcacatacgaacggtccaggaagaggacgacgacgacggctggtcgtacttcgtggtcgacggacgacccgacccccgngtacggaacggtccgacggtacggtcggacgccgtacgtacg

SEQ ID NO: 398674 - DNA, 629 bp, Homo sapiens
  misc_feature: GZ8MTXP02I5CT8.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagtcttggtccaggcccggggggtcctgagactctcctgtgcagcctctgctattcacctttagtaacttattaatgagtcgtgggtcccgccagccctccgaggggaaggggctggagtgggtgcccagcaattaaaccaagagtaggacctaagaaaaatctatgtaggactcgtgtagacgggcctattccgacctatcctcagacgaaccaaaccgaccaaaagaacctacgaacgtggtggctacgacaacgagttacggaaaccggtcccgtaggaacggacgggaccggaaccggtacgaccgggtctggttacgttaccttcgtggtcggacggaacggacccgaccccccgaggttacggaacgggtaccgtaacgtaggggtcggacgtaccgttaaccggttacg

SEQ ID NO: 398675 - DNA, 548 bp, Homo sapiens
  misc_feature: GZ8MTXP02H4ISX.38.4.A04.1.454.CMB.2.raw
  modified_base (256)..(256): a, c, t, g, unknown or other
  modified_base (292)..(292): a, c, t, g, unknown or other
  modified_base (303)..(303): a, c, t, g, unknown or other
  modified_base (346)..(346): a, c, t, g, unknown or other
  modified_base (445)..(445): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggcccgggggggtcctggagactctcctgtgcngcctctgctattcacctttagtaactatttaatgancgtgggtcccnccagcctcgaggggagggctggagtgggtgccagcataacagntggacgtagaaaatcatgtgactgtggtagaacggggcctattcgccatctaccagagacaacgccaaagactcactgtgctgcacagtcgaacggtcngaggacggcgacgacgacggctgtacgttacttcgtgtacgacggacgacccgacccccagtcggaacggggctaacgaggtcgggaacgtcgttaacgtacg

SEQ ID NO: 398676 - DNA, 687 bp, Homo sapiens
  misc_feature: GZ8MTXP02JF0SM.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagccctccgagggaaggggctggagtgggtggccagcattaaccaagatggacgtagaaaaatctatgtgactctgtgaaggccatcgccatctcagagacaacgcaagaactcactgtggctgcacatgaacggcctgagaggcgacgacacggctggtcgtacttctggtcgcgagccgcccccagtcggacggggctaccgaggtggggacgtcgttaccgtacttttggaaccttacgggtgggggacccaaacggggaaaccccgttcgggtcccgacccggttccctcccgttccaccgtccctacccgaacccgaaccggggacccctacgttcccggttccccttcccccgttccgggaccctacccccttcccctacccgaaccgacgacccgacccgtcggtacgggggccacggacgcccgggtcccgtcgggtccgtccggtccggttcgggaccgtaaacgggaccttaaccgttccgtaaccgtggtacgtaccggaaccgttgggccggg

SEQ ID NO: 398677 - DNA, 607 bp, Homo sapiens
  misc_feature: GZ8MTXP02GATCL.38.4.A04.1.454.CMB.2.raw
  modified_base (311)..(311): a, c, t, g, unknown or other
  modified_base (471)..(471): a, c, t, g, unknown or other
  modified_base (476)..(476): a, c, t, g, unknown or other
  modified_base (490)..(490): a, c, t, g, unknown or other
  modified_base (593)..(593): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattgggctgagcttgggttttccttgttgctattttagaaggtgtccagtgtgaggtgcaactggtggagtcgtgggggaggtcttggtccgagggcccgggggggtccctggacgactctcctgtgcagcctctgctattcaaccttttagtaacttatttaaatgagctcgggtccnccacgccctccgaggggaacgggctggaggtgggtcggccagctaacttaaaccaagtagtacgggaaccgtaaagaaaaattacgtaatggtaggaacttcgtggtaggaaacggggcctaagttcgcctaatccgtacgagacgaacaacgacgaaanacctnaactgtgctagcanagtgaaccggctagaccggagaccgacgacgacgtcgtgtcgttactcgtgtcgacgaacgcccgacccccagtgggaaccggtcgaacgtaggggcggaacnccgtaacgtttacg

SEQ ID NO: 398678 - DNA, 747 bp, Homo sapiens
  misc_feature: GZ8MTXP02JD140.38.4.A04.1.454.CMB.2.raw
  modified_base (316)..(316): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtagggacagagtcaccatcacttcgccgggcagtcagggctattaggacttcgtttagccgttggtactacgaagacgaaaaaaccgagggaaacctaccccctaacctcctagtatccgtaagtggtacncctaagtcctaattttacgacgtaaaaggttccggggtaccctaagtaccgtaaggttaccgaaggcggaccgtaggtggacttacggtcggggaacaaggtacttacacggttcctacaactaatacgaggtacccaagccctggactaggtcccgtagggaactacttacgtgacctaaacttttagttagtttactacttaactacggtttaactttaaacgtaccgttaacccccctagtttaacccggttttacggggaaccccggttaagggggtaacccttaaaaggggtttaccgggaaaataaacggtttaaaccccgaaaaaagggtacgtttccgggacggggtacccgtttaccgaaccgttaaaacccctaggttttccccgtaacgtttacccgtttcttaaaccctttcccccggg

SEQ ID NO: 398679 - DNA, 669 bp, Homo sapiens
  misc_feature: GZ8MTXP02HCNC2.38.4.A04.1.454.CMB.2.raw
  modified_base (302)..(302): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctggagactctcctgtgcagcctctgcattcacctttagtaacttatttaatgagcgtcgggtccnccagccctccgaggggaggggctgggaggtggggtcggcccgaggactaacttaaaccgaagacgtaggaacccgtaagaaaaactacgtaatggtaggacttcgtagtaggaaacggggccgtattccggacctactccctaccgaagaacgaaccaaaccgacccgaaaacgaacctacctaacgttggtacggtccgtagaccgtaacgaacgtacggaaaccgggtccgtaggaacggacggggaccggaaccggaaccgacggtaccgtaggtacgttaaccgtttcgtacggtcggacgtacggacccgcccccgaggtcggaacggcgtaacgagggtacggacgtacgtacgttaaccg

SEQ ID NO: 398680 - DNA, 547 bp, Homo sapiens
  misc_feature: GZ8MTXP02HS7IH.38.4.A04.1.454.CMB.2.raw
  modified_base (258)..(258): a, c, t, g, unknown or other
  modified_base (425)..(425): a, c, t, g, unknown or other
  modified_base (497)..(497): a, c, t, g, unknown or other
  modified_base (529)..(529): a, c, t, g, unknown or other
  modified_base (538)..(538): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccgaggccgggggggtccctggagactctcctgtgcngcctctgcattcacctttagtaactattaatgagctgggtccgcagcctccgagggaggggctggagtggggtggcccagcaattaaaccaagatggaccgtagaaaaatctatgtggactctgtgaagggccgtattcgccatctccagacacaacgcaaagactnactggtgctgcacagtaggaccgccgtgaagacgggcgtaacgacacgggctgggtactactttcgtggtcncggaagacccgcccccagtggaagggctacgnggtgggacnctacgtacg

SEQ ID NO: 398681 - DNA, 521 bp, Homo sapiens
  misc_feature: GZ8MTXP02GAM2K.38.4.A04.1.454.CMB.2.raw
  modified_base (326)..(326): a, c, t, g, unknown or other
  modified_base (447)..(447): a, c, t, g, unknown or other
  modified_base (501)..(501): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggccggggggtccctgagactctcctgtgcagcctctgcattcacctttagtaactatttaatgagctgggtccgccagcctccgagggagggctggagtgggngccagcataaccagatggaccgtagaaaatctatgtggactctgtgaagggccgattcgccatctcagagacaacgcaaagactcactgacgctgcacatagacgctagagagcgacgacncggactgtagtacttcgtgtcgcgacgaccgcccccgagtcggaacggctacgnggtcgggactcgtacgtacg

SEQ ID NO: 398682 - DNA, 707 bp, Homo sapiens
  misc_feature: GZ8MTXP02GUJUD.38.4.A04.1.454.CMB.2.raw
  modified_base (328)..(328): a, c, t, g, unknown or other
  modified_base (365)..(365): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccgagggaagggctggagtgggtggccagcattaaccaagatggacgtagaaaaatctatgtggactctgtggaagggccgattcgccatcctccagagacaacgccaaagaactcactgtggctgcacatgaacgcctggagaggcgacgacacggctgtntacttcgtgtgcgagacgccccagtggacggctacgnggtcgggatcgtacgtacgtttgaccttacggcggggaccaacgggtaacccgtcggtaccctaccgtcctccctccgacgcccctacccgaaccgaaccgggacccctacggtccccgggttccccttcccccggtacggtaccccctaccccctaccctacccgaaacggaccgtaccgtaacccggttcggccgggggaccaaacccgggtccgggtaccccgggccccggttcgggggaacccgttccgggtcccggttacgggtaacccgaaacgggtaacccttaacccgttacccggactaaacgttcggaacgttacccggaacgttacggggg

SEQ ID NO: 398683 - DNA, 739 bp, Homo sapiens
  misc_feature: GZ8MTXP02IJ90W.38.4.A04.1.454.CMB.2.raw
  modified_base (286)..(286): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggagggctggagtgggtgccagcattaaccaagatggacgtagaaaatctatgtggactcgtgtaggaaggcgattcgcatctcagagacaacgcaagactcactgtgctgcanatagaacgctgagaggcgacgacgacggctgtgttacttcgtgtgacgagaccgcccccagtggacggtctaacgnggtacgggactccgttaacgtactttcggaccgttacgggtcgggggacccgtaaacggggtaaacccgttcgggtacccgtacccgttcctcccgtaccgtaccgtaccccttacccgaaacccggaaaccggggtccccctaaccggtttccccgggttacccccgtttcccccgtacgggtaccccctacccccgtttacccgaacccgaaacggtaccgacccgtaacccgtccggggtaccgggggacccaaccggtacggccccgggtacccggtcggggtcctaccggtacccggttacgggtaccgtaaaccggtacctttaacccgtccgtacggttacggacgttaccggtacgttacggaacgggg

SEQ ID NO: 398684 - DNA, 731 bp, Homo sapiens
  misc_feature: GZ8MTXP02JCMZM.38.4.A04.1.454.CMB.2.raw
  modified_base (269)..(269): a, c, t, g, unknown or other
  modified_base (362)..(362): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaacttatttaatgagctgggtccgccagcctccgagggaagggctggagtgggtggccagctaattaaccaagatggacgtagaaaaatctatgtaggactctgtggaagggccattcgccatctaccaganacaacgcaagactcactgtgctgcacagtcgaacggcctggagaggccgacgacgacggctgtcgttacttcgtgtgcgagaccgcccctagnggaggctacgaggtgggatacgtacgtacgtttgaccgttacggcggggaccgtaacggggtaacccttggcctacccgtcctccgtccgaaccgtcccctaccaaacccggtaacgggcccctaacgttcccggttcccccgtttccccgaaccggtccccttaacccccgtccctaacccggaaacgacccggtacccgtaacccgttcggggtccgggggaccgtaaaccggcccgggtccccgggaacccggttcgggggtacccgttaccgggtacccccggttgggaaccccgtaaacggtacccttaaacccgtttcccggaacgttacggtaactcccggtaaacggttcgggacccgggg

SEQ ID NO: 398685 - DNA, 628 bp, Homo sapiens
  misc_feature: GZ8MTXP02JNCWO.38.4.A04.1.454.CMB.2.raw
  modified_base (370)..(370): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcaattaaccaagatggacgtagaaaaatctatgtggactctgtgaaggcgattcgccatctcagagacaacgccaagactcactgtgctgcacatcgaacggcctgagaggcgacgacacggctgtgtacttctgtgcgagacgccccagtggacggctacgaggtggggacncgttaacgtacgttttggaccgtagtcgggggaccctaacggggtaacccgtcgggtaccacccggtcctaccctcgaacgccctccgaaccgaacgggcccctacgtccggttcccttccccgtcggccctaccccttcccgtaccacgtacgacccgtaccgtcggtacgggggccaacgccggccggtcccgtgggcctcggaccgtcggtacgaacggtactaacgtccgacggtcagtacgtcgtacggcggg

SEQ ID NO: 398686 - DNA, 585 bp, Homo sapiens
  misc_feature: GZ8MTXP02JLGES.38.4.A04.1.454.CMB.2.raw
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtccctgagactctcctgtgcagcctctgcattcacctttagtaactatttaatgagctgggtcccgccagcctccgaggggaaggggctggaggtgggtcggccagcattaaccgaagatggacgtagaaaaatactatgtggactcgtggtagaacgggccagtttccgcctatcctaccgagaacgacaaacgaccaaagaactcaactgcgactgacactagtacggaaaccggcctaggaacgagtacgacgaccgacgggctggtcgttaccttgtcggtcgacggacgaccccgcccccaagtgggacggtaccgtacgtagggtacggacgtcgttaaaccgg

SEQ ID NO: 398687 - DNA, 604 bp, Homo sapiens
  misc_feature: GZ8MTXP02JBVUX.38.4.A04.1.454.CMB.2.raw
  modified_base (307)..(307): a, c, t, g, unknown or other
  modified_base (460)..(460): a, c, t, g, unknown or other
  modified_base (493)..(493): a, c, t, g, unknown or other
  modified_base (509)..(509): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccgaggccggggggtcctgacgactcctctgtcgcacgcctctgctacttctacctttagtaacttattaatgagcgtcgggtccncacgcctcggaggggaggcgtggaggtggggtcgcagctaacttaaaccaagagtcggaacgtaagtaaaatactagtgtacggaacttcgtggacgggaaacgggccgtagttccgactactcctacgagacgaacacgaccaaagacctanacgtgtcgctacgcacagtcgaaccgtcagagnggacgacgacacgggntcgtgtacttctaggtcgacgacggacccgaccccctagtacgggaacgggaccttaacggacgggttacggggacgtccgtttaacggttaacg

SEQ ID NO: 398688 - DNA, 587 bp, Homo sapiens
  misc_feature: GZ8MTXP02JMTZW.38.4.A04.1.454.CMB.2.raw
  modified_base (302)..(302): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggtcttggtccgagggcccgggggggtccctggagactctcctgtgcagcctctgcattcacctttagtaactattaatgagcgtggtccnccagcctccgaggggagggctggagtgggtcggccaggctaattaaaccagtataggaccgtagaaaaatctagtggtaggactcgtaggtaggaaacggggcccgtattccggacctagtcctaccgaagacgaaccaacgaccaaagacctacacgtgtacgctgacacacgtacgaaccggcctagacggaggacgacgacgacggctgtcgttacttcgtggtacgcgacgccgacccccagtcggaacggctaacggaggtaggacgtacgtacgttacg

SEQ ID NO: 398689 - DNA, 610 bp, Homo sapiens
  misc_feature: GZ8MTXP02HMKBD.38.4.A04.1.454.CMB.2.raw
  modified_base (331)..(331): a, c, t, g, unknown or other
  modified_base (368)..(368): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtgccagcattaaaccaagatggacgtgaaaaatactatgtggactctgtgaagggccattcgccatctccagagacaacgccaagaactcactgtggctgcacatgaacgctgagaggcgacgacacggctgtgtactttcngtgcgagacgcccccagtgagggctacgaggtggganctacgactttgacctacgcggggaccacgggaaccctggtccgaccgtctcctcacgccctaccaaccgaacgggccctagtccggttcccttcccccgtcggcccacccctccctccaaacgacgcctaccgtcggtcgggggccacgacggccggcccgtggggcctcggcccgtcggtaccgaacgggtaccttaaccgttccctaacgggttcgaacgtcggtacgttcggaacgggg

SEQ ID NO: 398690 - DNA, 732 bp, Homo sapiens
  misc_feature: GZ8MTXP02HCYKD.38.4.A04.1.454.CMB.2.raw
  modified_base (335)..(335): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggcccgggggggtccctggacgactctcctgtgcagcctctgcattcactttagtaacttattaatgagcccggtccgccagccctccgaggggagggctggagtgggttnccgagcaattaaacccgaaagatagggaacgtagtaaaaactacgtaatggtaggtaccttcgtggtacggaaacgggggtccctaagtttccgaccctagtcccttaccccgaaggaaccgaacccgaaaccggacccaaaagtaaaccgtaccgaacgttacggtacggggtacctcggaccaaccgtaacgttaacgggtaaacccggcccgttaggggaaaggaaccggggaccgggaacccggtaaccgaaccgggggtccttacggtttacgttaacccgttttccgtaggttcggaccggaaacgacccggcccccccaaagttcgggacggggtaacccgtaaccggagggtacggggtaacgtacccgtaaccggtaacgtttaccgg

SEQ ID NO: 398691 - DNA, 553 bp, Homo sapiens
  misc_feature: GZ8MTXP02I9UUR.38.4.A04.1.454.CMB.2.raw
  modified_base (305)..(305): a, c, t, g, unknown or other
  modified_base (376)..(376): a, c, t, g, unknown or other
  modified_base (405)..(405): a, c, t, g, unknown or other
  modified_base (411)..(411): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggcttggtccgagggcccgggggggtccctgagactctcctgtgcagcctctgcattcaacctttagtaacttatttaatgagctgggtccncagcctcgagggagggctggagtgggtgccagcattaaccagatggaccgtagaaaatctatgtaggactntgtggaagggccgattcgcatctccaganacaacnccaaagacctcactgtgctgcacatagaaccgctagagacggcgacgacgacggcttgtacgtacttcgtagtcgacggtacgcccgacccccagtcggaacggtcctaacggacgggtacggacgtaccgtacgtttaacg

SEQ ID NO: 398692 - DNA, 578 bp, Homo sapiens
  misc_feature: GZ8MTXP02FZI1X.38.4.A04.1.454.CMB.2.raw
  modified_base (368)..(368): a, c, t, g, unknown or other
  modified_base (499)..(499): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtggccagcattaaccaagatggacgtgaaaaatctatgtggactctgtgaagggccgattcgccatctccagagacaacgccaagaactcactgtgctgcacatgaacggcctgagaggcgacgacacggctgtgtacttctgtgcgagacgccccccagtggagggctacaggtggganctacgactttgaccttacgtgggggccacggggtaaccctggtccaccgtctcctcagccctcaccgaacgggcccagtccggtcccttcccccgtcggccacccctcctaccaaacgcgccaccgttcgngggggcaacgcgccggccctggggctcggccgtggtaccaaggtacctaacgttcccacgttcgactcgactcggacgg

SEQ ID NO: 398693 - DNA, 658 bp, Homo sapiens
  misc_feature: GZ8MTXP02I21FT.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagtcgttggtccgagggccggggggtccctggagactctcctgtgcagcctctgctattctaacctttagtaacttattaatgagcgtcggtccgccacgcctacggaggggaaggggctgggaggtgggtcggacccaggacctaaagttaaaccgaaggtagtaggaaccgtaaagtaaaaaattaccgtaagtcggtaggacttcgtaggtacggaaacggggtccgtaacgttccggacctagtacctaccgaagaacgaaccaaacgacccgaaacgtaactacgtacgtgtacgctgaccacacgtacggaacggtccgagaacggacggacgacgacgaccggtctgtacgttacttcgtagtcgacggacgtacccgacccccgtagtacggaacggaccgtaacggaggtacggacgtaccgttaacgttaaccg

SEQ ID NO: 398694 - DNA, 725 bp, Homo sapiens
  misc_feature: GZ8MTXP02HHJVP.38.4.A04.1.454.CMB.2.raw
  modified_base (298)..(298): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggtcttggtccgagggcccgggggggtcctggacgctctcctgtcgcagcctctgctattccactttaagtaacttatttaangagtcgtcggtccgccacgccgtaccggaaggggacggggctagggaggtggggtcggccctaaggacctaaagttaaaccgaaaggtacggttacggaaacccggttaaagaaaaaaacgtttctaagttacgggtacgtacttccggttagggtaacgggtaaaccggggtcccgtaacgtttccggaccctactcccgtaccgaaacggaacgaacccgaaaaccggaacccaaaaggtaaaccctccgtaacttaccgtcgggtacctaggacccaaagtacggttacggaaccggtaccgaggacggagacccgaacgtacgacggtcgtgttacgtacttgtgtcggacgtaacgcccgacccccgtaggtacggaacgggttaccacgggttaggacgggactaccgttaacgttaccgg

SEQ ID NO: 398695 - DNA, 687 bp, Homo sapiens
  misc_feature: GZ8MTXP02H0GZP.38.4.A04.1.454.CMB.2.raw
  modified_base (290)..(290): a, c, t, g, unknown or other
  modified_base (300)..(300): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggagcttggtccgaggccggggggtcctgagctctcctgtgcagcctctgctattcacctttagtaacttattaatgancgtggtaccnccagccctccgaggggaaggggctaggaggttgggtggaccagactaattaaaccgaaagagtaggaccgtaagaaaaacttctaagttgtacgggtactcgtagggtaggtaacgggccgtaactttccgacctaacttccctaccgaacggaaacgtaacccaaaacccggacccaaaacggtaaacctcgtaaaccgtgggttacggccgtacggacctaaccgtaagttacggaaacccgggccgtaaggacggacgggacgaccggtacgaaccgggtcgttagttacgtttacgttcgttagtcggacggtaacggcccgaccccccgtagtagggaacgggtcgtaaccggaggtggggaccgtacgttacgtttaaccg

SEQ ID NO: 398696 - DNA, 663 bp, Homo sapiens
  misc_feature: GZ8MTXP02HRBKQ.38.4.A04.1.454.CMB.2.raw
  modified_base (284)..(284): a, c, t, g, unknown or other
  modified_base (321)..(321): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactattttaatgagctgggtccgccagcctccgaggggaaggggctggagtgggtgccagcaattaaccaagatggacgtagaaaaatctatgtggactctgtgaagggcattcgccatctcagagacaacgcaagaactcactgngctgcacatgaaccggctggagaggcgacgacacggntgtgtacttgtgtgcgagtccgcccccagtaggacggctacgaggtcgggatcgtacgtactttaggaccgttacggtcgggggacctacggggtaaacccgtggtcccgtacccgtctcccgtcaccgtccctaccgaacccgaacgggtccccacgtttccccgggttcccctttcccccgcggtacccctaccccgttccgtaccaacgaccgccgtaccgtccgggtaggggcccgacgaccgggcccgccggttcggccgtacgtccgtcgggtaacctacgggtaaaccttccgttacccgacggtttcgaacgttccggtaacggttcggccggg

SEQ ID NO: 398697 - DNA, 743 bp, Homo sapiens
  misc_feature: GZ8MTXP02ILXCZ.38.4.A04.1.454.CMB.2.raw
  modified_base (280)..(280): a, c, t, g, unknown or other
  modified_base (310)..(310): a, c, t, g, unknown or other
  modified_base (324)..(324): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcacatggaattggggctgagcttgggttttccttgttgcttattttagaaggtgtccagtgtgaggtgcaacgtgggtggagtcgtgggtggggaggtcgttcggtccgacggggcccggggggtccctggacgtactcctccgtgtgcacgcctgngctattcctacctttaagtaactatttaangagtcgtcggtccncgacgccgtccggaaggggacgggcgtgggtagggtgggtcggacagtactaaagttaaaccgaagtagtacggaacgtaaagaaaattactaggttaggtacgtactcggttagggtaacgggaaccggggtaccgttacgttacccggtacctaaccgtttcccgaaccggaaacggaacgaaaacccgaaaacccggaaacccgaaaaacggtaaaccttacccggaaaccgtttggggaccgtccggttacggaccaaacgttacggaacgggaaccgggtccgaaggacggacggaccgacgtacgacggtcgtagttcgttacgttcgtacggcggaccggaaccgaccccgaccccgtaggtaacgggaacggtacgtacggagggtaccggacgttacccgtttaaacggg

SEQ ID NO: 398698 - DNA, 625 bp, Homo sapiens
  misc_feature: GZ8MTXP02IVJWY.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccgggggggtccctgagactctctgtgcagcctctgcattcacctttagtaacttatttaatgagtcgtgggtccgccagccctccgaggggaaggggctggaggtggggtcggcccagctaacttaaaccgaagatggaaccgtagaaaaatctatgtggactcgtggtggaaacgggccgtagttcgacctatcctaccgaggacgaacaaaccgaccaaaacgtaacctactacgtaggtcggcttcggacctacgaacgtcgggaaaccggccgtagggaacgacggggacggacgaaccgacgggtcctggtcgttacgttcgtaggtcgccggacgaccgacccccgcgtggaacgggtccaacgtacggtaggggacgtacgttaacgttacg

SEQ ID NO: 398699 - DNA, 716 bp, Homo sapiens
  misc_feature: GZ8MTXP02ICR3A.38.4.A04.1.454.CMB.2.raw
  modified_base (230)..(230): a, c, t, g, unknown or other
  modified_base (264)..(264): a, c, t, g, unknown or other
  modified_base (270)..(270): a, c, t, g, unknown or other
  modified_base (306)..(306): a, c, t, g, unknown or other
  modified_base (324)..(324): a, c, t, g, unknown or other
  modified_base (331)..(331): a, c, t, g, unknown or other
  modified_base (361)..(361): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaatactatgnggactctgtgaagggccattcgccatctccaganacaacncaagactcactgtggctgcacatgaacggcctgagnggcgacgacacggctgtntacgttntgtgcgagaccgcccccagtgagggctacnggtgggactcgtacgtactttgacctacggtgggggccagggaaccctggacctaccgtctcctcacgccctccaacccgaacgggcccctacgtccggttccccttcccccgtacgggtcccccaacccccgttcccgtaacccgaaaccggtaccgtacccgtaacccggttccggttaccggggggaccaaccggacgggaccccggggtcccccggttcgggggtcccgttccgggtaccccggttacggggttaacccggtaaaacgggtaccccgtttaaacccgtttacccccggtaaacggttaccggtaacgttacccgggttaccgttaacgggggacccggggg

SEQ ID NO: 398700 - DNA, 629 bp, Homo sapiens
  misc_feature: GZ8MTXP02GZJH9.38.4.A04.1.454.CMB.2.raw
  modified_base (162)..(162): a, c, t, g, unknown or other
  modified_base (236)..(236): a, c, t, g, unknown or other
  modified_base (614)..(614): a, c, t, g, unknown or other
tcagtcgatcacgtcacgaccggtgctcgatttagagtagtgatcagggggaagaccgatgggcccttgggggaggcttggtccaggccgggggggtccctgagactctcctgtgcagcctctgcattcaccttttagtaactatttaatgagctgggtccnccagcctccgagggaagggctggagtgggtgccagcattaaccaagatggacgtagaaaaatctatgtggactntgtgaaggcctattcgccatctacagagacaacgccaagactcactgtgctgcacagtgaacgctagagaggcgacgacacggctggtgtacttcgtgtgacgacgaccgcccccagtggacggctaacgaggtggactcctaacgtactttacgaccgttacggcggggaccaacgggaaaccctggttcccgacccgtcctaccctcacgccctacccaacgaaccgggcccctaagttcccggttccccttccccgtccggaccaccccttcccgaccaaacgcgacctaccgtcggacggggaccacgccggccggcccgtggccgtcgaccggtcgtaaccgaacgtacctaaccgttccgaacgtcgtaacnccggacgtacggcgg

SEQ ID NO: 398701 - DNA, 613 bp, Homo sapiens
  misc_feature: GZ8MTXP02INLAK.38.4.A04.1.454.CMB.2.raw
  modified_base (292)..(292): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccgggggggtccctggagactctcctgtgcagcctctgcattcacctttagtaacttattaatgancgtgggtcccgccagcctccgaggggaaggggctggagtggggttgccagctaattaaaccgaagagtaggaccgtaagaaaaatctagtgtggactcgtgtaggaacgggccattcgcctatcctaccagacgacaacgacccaaagacctacaactgtcggctaggcaacagtagaaccggccgtaggacggagggaccggaacgacgaccgggtactcggtacgttacgttcgtggtcggaccgacggaccgaccccccgtaggtacggaacggggtcctaaccggagggtacggggaaccgtcgttaaccggttacg

SEQ ID NO: 398702 - DNA, 588 bp, Homo sapiens
  misc_feature: GZ8MTXP02F4XIL.38.4.A04.1.454.CMB.2.raw
  modified_base (307)..(307): a, c, t, g, unknown or other
  modified_base (321)..(321): a, c, t, g, unknown or other
  modified_base (372)..(372): a, c, t, g, unknown or other
  modified_base (534)..(534): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtagaaaaaatctatgtggactctgtgaagggccgattcgccatctccagagacaacgccaagactcactgtgctgcacatgaacggcctgagnggcgacgacacggntgtgtacttctggtgcgagacgcccccagtggacggctacgaggtggggancgtacgtactttgaccttacggtcgggggacccaagggtaacccgttggtccctacccgtctcctcacgccctccaaccgacgggcccagttccggtcccttccccgtcgcccaccctcctccaaacgcgcctaccgtcgcggggacacgacgccggtccgnggctcggctcggtacaacggtactaaccgtcacgtcgacgtcgacgtcgacggg

SEQ ID NO: 398703 - DNA, 601 bp, Homo sapiens
  misc_feature: GZ8MTXP02F3J9H.38.4.A04.1.454.CMB.2.raw
tcagtcgatcacgtcacgaccggtgctcgatttagagtagtgatcagggggaagaccgatgggcccttgggggaggcttggtccagccggggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggcgattcgccatctcagagacaacgcaagaactcactgtggctgcacatagaacggctgagaggcgacgacacggctgtgtacttctgtcgcgagaccgcccccacgtgacgggctacgaggtgggagctacgtactttgactacgtcgggggaccacgggtaacccgtggtacctaccgtctcctcacgccctacccgaaccgaacgggaccctacgtccgttcccttaccccgtcgccctacccctcctaccgaaacgcgacaccgtacggcgggggaccacgacggccggcccgtgggcgtcgcgtcggtacaacggtacctaacgttccgacgtcgactcggactggacgg

SEQ ID NO: 398704 - DNA, 617 bp, Homo sapiens
  misc_feature: GZ8MTXP02IOE4U.38.4.A04.1.454.CMB.2.raw
  modified_base (254)..(254): a, c, t, g, unknown or other
  modified_base (259)..(259): a, c, t, g, unknown or other
  modified_base (358)..(358): a, c, t, g, unknown or other
  modified_base (367)..(367): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtgccagcattaaccaagatggacgtagaaaaatctatgtggactctgtgaaggccattcgcatcncaganacacgcaagactcactgtgctgcacatgaacgcctgagaggcgacgacacggctgtgttacttcgtgtgcgagacgcccccaagtggacgggctaacgnggtcggganccgtacgtactttgaccttacggtcgggggacctacggggaaccctggcctaccgtcctcctcacgtccctaccgaccgaacgggcccacgtccggtcccttccccgtcggaccctccccttcccgacccgaacgaccgtccaccgtcggtcggggaccacgacggccggcccgttgggccttcggacccgtggtaccaaggtaccgttaaccttacccgacgttacgacgtccggtaacgtggaccggg

SEQ ID NO: 398705 - DNA, 553 bp, Homo sapiens
  misc_feature: GZ8MTXP02GAGJT.38.4.A04.1.454.CMB.2.raw
  modified_base (299)..(299): a, c, t, g, unknown or other
  modified_base (544)..(544): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttggtccaggccgggggggtccctgagactctcctgtgcagcctctgcattcacctttagtaactatttaatgagcgtgggtccnccagcctccgagggaagggctggagtgggtgccagcataaccagatggaaccgtgaaaaatactatgtacggactcgtgtagaaacggggccgtagttcgcctaatcctaccaaggacgaacaacgaccaaagaaccttacaactgtacggctgaccacatcgaacggccgtagacgaggcgacgacgacggctggtctactctggtcgcgagacgcccccagtcgaagggctacgagtgggacnctacgtacg

SEQ ID NO: 398706 - DNA, 610 bp, Homo sapiens
  misc_feature: GZ8MTXP02I115O.38.4.A04.1.454.CMB.2.raw
  modified_base (266)..(266): a, c, t, g, unknown or other
  modified_base (415)..(415): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttgccgggcagtcagggcattggacttcgttagctggtatcagacaaaacgagggaacncccctaactcctgatctatggtcgctatcctagttttcgacgtaaaggtcggggtacccagtcgaaaggttcaggtcggccaggtggatacgtgggacaggtatcgagtctacacaatcagcagcctgacacgcgtagagtactacgtntactaacttagtttatacggttactaacacgttacttaaactaacccgtttaccccctaacgttacgttttacggacccggtaagggggtaaccctaagggtttcgggaacttaagtaaccgtaaaaacggtcttacgggtacgctaacggtcctaaacctcgttaccgtcgttaccttacgtacctttaccccg

SEQ ID NO: 398707 - DNA, 685 bp, Homo sapiens
  misc_feature: GZ8MTXP02IQMH7.38.4.A04.1.454.CMB.2.raw
  modified_base (311)..(311): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggcgttggtccgagggcccggggggtccctggagacctctcctgtgcacgcctctgcattctacctttagtaactatttaatgagcgtgggtcccncccgagccctccgaggggaaggggcgtggaggtgggtcggaccaggcaacgttaaccaagatggacgtaagaaaaatctaatggtaggactcgtgggtaggaacggggccgtagttccgacctatcctaccaacggacgaacgaaaccgacccaaaacgaacctaccgtaacgtggtacggcttacgacctacgaacgtacggaaacccggtccgtaggaacggacggaccggaccgaacgaccggtctacggttcgtttaaccgttcgttacggtcggtccggaacgtacccgaccccccgtaaggtcggggtaacccggggtacgtaaccggtaggggtacggggtaccggtaccgttaacgggtttaaccg

SEQ ID NO: 398708 - DNA, 536 bp, Homo sapiens
  misc_feature: GZ8MTXP02IKHNC.38.4.A04.1.454.CMB.2.raw
  modified_base (329)..(329): a, c, t, g, unknown or other
  modified_base (381)..(381): a, c, t, g, unknown or other
  modified_base (396)..(396): a, c, t, g, unknown or other
  modified_base (435)..(435): a, c, t, g, unknown or other
  modified_base (451)..(451): a, c, t, g, unknown or other
  modified_base (455)..(455): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcaccttttagtaactatttaatgagctgggtccgccagcctccagggaagggctggagtgggtggccagcattaaccaagatggacgtgaaaaatctatgtggactctgtgaagggccattcgcatctcagagacacgcaagaactcactgtggctgcacatgaacggcctgagaggcgacgacacggctagtgtacttctgngcgagacgcccccatgagggctacaggtggagctacgactttgactacgggngggacaggacctgcncgtctcgcgcctccaacgacggccagtcgtccttcccgngccaccctcacaagcncacncgcggcgacgacgcgccgcggcgcgtcgtcgtacgaacgtactactaaccgtacgtacgtactacgtacgtacgacggcgg

SEQ ID NO: 398709 - DNA, 515 bp, Homo sapiens
  misc_feature: GZ8MTXP02I0P3I.38.4.A04.1.454.CMB.2.raw
  modified_base (297)..(297): a, c, t, g, unknown or other
  modified_base (326)..(326): a, c, t, g, unknown or other
  modified_base (437)..(437): a, c, t, g, unknown or other
  modified_base (462)..(462): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcttggtccaggccggggggtccctgagactctcctgtgcagcctctgcattcacctttagtaactatttaatgagctgggtccnccagcctccgagggaggctggagtggttncagcataacagatgacgtagaaaatctatgtggactcgtgtgagggccattcgcatctcagacgaacaacgaccaaagactcactgtagctgcacatgaacggtctgaagnggcgacgacacggctagtgtacttntggtgcagaccgcccccatcggaaggcctacgaggtgggactcgtacgttacg

SEQ ID NO: 398710 - DNA, 604 bp, Homo sapiens
  misc_feature: GZ8MTXP02JJPW9.38.4.A04.1.454.CMB.2.raw
  modified_base (318)..(318): a, c, t, g, unknown or other
  modified_base (414)..(414): a, c, t, g, unknown or other
  modified_base (485)..(485): a, c, t, g, unknown or other
  modified_base (503)..(503): a, c, t, g, unknown or other
  modified_base (519)..(519): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggaggtcgttgggtccgagggcccgggggggtccctggagacctctcctgtgcagcctctgctattcctacctttaagtaaacttattaactgagtcgtagggtccnccagtccctccgaaggggaaggggctggaggtggggtcgaccagctaattaaaccaagagtggaaccgtaagaaaaatctaatggtagactcgtgnggaaacggggcctatccgactacgtacctcgagacgaacaacgaccaaagacctacaactgtcgctgacanagtcgaacgtccgagagnggacgacgacgacggntgtacgttacttctggtcgaccggaacgcccgacccccgagtcggaacgggtctaccggaggtcgggacgtaccgtacgttaacg

SEQ ID NO: 398711 - DNA, 568 bp, Homo sapiens
  misc_feature: GZ8MTXP02IPBBQ.38.4.A04.1.454.CMB.2.raw
  modified_base (267)..(267): a, c, t, g, unknown or other
  modified_base (296)..(296): a, c, t, g, unknown or other
  modified_base (309)..(309): a, c, t, g, unknown or other
  modified_base (398)..(398): a, c, t, g, unknown or other
  modified_base (417)..(417): a, c, t, g, unknown or other
  modified_base (422)..(422): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactgggtgggagtcgtggggggaggcttgggtccagggcccgggggggtccctgagcctctcctgtgcagcctntgcatttcacctttagtaacttatttaangagctgggtcccnccagccctccgaggggaaggggctggagtggggtcggcccaggcaattaaaccaagatggaacctagaaaaatctatgtggactcgtgngaaggggccattcgcatcncaganacaacgaccaaagactacactgcgctgcaacatacgaccggctaggaggacggacgacgacgacggtactgtcgttacttcgtgtcggacgacgaccgcccccgagtcggaacgggcaacgtggtacgggacgtcgtaacgttacg

SEQ ID NO: 398712 - DNA, 652 bp, Homo sapiens
  misc_feature: GZ8MTXP02G0GJB.38.4.A04.1.454.CMB.2.raw
  modified_base (302)..(302): a, c, t, g, unknown or other
  modified_base (315)..(315): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtcgtgggggaggtcgttgggtccgagggcccgggggggtccctggagactctcctgtcgcagcctctgctattccacctttagtaacttatttaangagcgtgggtccnccagcctccgaggggaggggctgggagtggggtgccagcaacttaaaccgaagagtaggaaccgtaagaaaaacttctaagttggtacggacttcgtggtacggaaacggggcccgtaatttccggacctacgttacctccgaagacgaaccaaccgacccgtaaaagacctactaaccgtggcggtctacggacgaactacgttacggaaccggtccgtaggaggacggaccggacgacgaccggtcgtgtcgtacttcgtagtcgacggacgtaccgacccccgagtacggaacgggtcctaacggtaggtcgggacgtaccgtacgtttaccgg

SEQ ID NO: 398713 - DNA, 645 bp, Homo sapiens
  misc_feature: GZ8MTXP02JYQ4G.38.4.A04.1.454.CMB.2.raw
  modified_base (308)..(308): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatactatgtggactctgtgaagggccgattcgccatctcagagacaacgccaagactcactgtggctgcacatgaacggcctgagnggcgacgacgacggctgtgtacttctggtgacgagaccgccccacgtggaggctacgaggtggggatcgtaacgtctttagaccgtacggtcggggaccaacggggtaaccctcggtccacccgtctccctcacgccctacccaccgacgggcccctacgttcccggttccccttcccccgtcggaccctacccccgttcctacccgaaacggacctacccgtacccgttcgggaccgggggccaccggaccggcccgggtcccgtggggccctcggccgttacggtaccgaacggtacctaaccgttcccgacggttcgactcggacgtcggcggg

SEQ ID NO: 398714 - DNA, 625 bp, Homo sapiens
  misc_feature: GZ8MTXP02F667Q.38.4.A04.1.454.CMB.2.raw
  modified_base (260)..(260): a, c, t, g, unknown or other
  modified_base (299)..(299): a, c, t, g, unknown or other
  modified_base (327)..(327): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggtttccttgttgctatttagaaggtgtccagtgtgaggtgcaacgtggtggagtcgtgggggaggcttggtccgagggccggggggtccctgagactctcctgtgcagcctntgcattcacctttagtaactattaatgagtctgggtccnccagcctcgagggagggctggagtgggngccagctaataaaccagactggaccgtagaaaaatctaagtgtacggacttcgtgtaggaaaggggtcccaagttccggacctatcctacccaaggaacgaaaccaaacgacccgaaaagtaaccctcaaaccgttgggtacgctacggacaacgaacgttacggaaaccggcccgtagggaacggacggacgaccggaacgaccggcgttgtacggttaacctttgtacggtcgacgacgaccgtacccccagttggaacgggctaacggagggtgggactaccgtacgtttaaccg

SEQ ID NO: 398715 - DNA, 688 bp, Homo sapiens
  misc_feature: GZ8MTXP02HO8ES.38.4.A04.1.454.CMB.2.raw
  modified_base (192)..(192): a, c, t, g, unknown or other
  modified_base (261)..(261): a, c, t, g, unknown or other
  modified_base (310)..(310): a, c, t, g, unknown or other
  modified_base (507)..(507): a, c, t, g, unknown or other
  modified_base (663)..(663): a, c, t, g, unknown or other
tcagtcgatcacgtcacgaccggtgctcgatttagagtagtgatcagggggtctcagagaggagccttagccctggactccaaggcctttccacttggtgatcagcactgagcaacagaggactcaccatggaattggggctgagcgttgggttttccttgttgcttattttagaggtgtcagtgtgaggtncaactggtggagtcggtgggggaggcgttggtccgagggcccgggggggtcctgagactctcctgtgcngcctctgctattctactttagtaacttattaatgacgtcgtcgggtccnccacgcccgtaccggaaggggaggggcgtggggacggtggggtcggccgaggactaacttaaaaccgaaggtagtagggtaaaccgtaagaaaaaacttcgtaagttggtacggtactcgttaggtacgggaaacgggccgttaagttcccgactactccgtacaaggacgaaacaaccgacccaaaagaacccgtnaacgttggcgggtactaggccaaacgtaaggttacgggaaaccgggccgttaggaacgggacggggaccgtaaacggtaccggacggttccgtagtacggtttccttgttacggcggactacgcccgtaccccacgacgggaacggactaacgggngggacggtacgtacgttacgttacg

SEQ ID NO: 398716 - DNA, 679 bp, Homo sapiens
  misc_feature: GZ8MTXP02F8LZN.38.4.A04.1.454.CMB.2.raw
  modified_base (262)..(262): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccgggggggtccctggagactctcctgtgcagcctngcattcacctttagtaactatttaatgagctgggtccgccacgcctccgaggggaggggctggagtggggtggccagctaattaaaccgagatggaaccgtagaaaaatctatgtagggtactcgtaggtacggaagggggcccgaagtttcccggaccctaattccctaccgaacgaacgaaccgaaaccgacccgaaacgaaaccctcgaaaccgttggtcggcttcggcctaacacgtacggaacggcccgtagaacggagggaccgaacggacgaacgggcttcgggtacgttaccgtttcgtacggtcggtaccggaacggacccgaccccccgaacggtaccgggaacggggtaccgttaaacggtaccggggtagggggtaaccggtaccgttaaccggtttaaacccgg

SEQ ID NO: 398717 - DNA, 612 bp, Homo sapiens
  misc_feature: GZ8MTXP02HMDRJ.38.4.A04.1.454.CMB.2.raw
  modified_base (260)..(260): a, c, t, g, unknown or other
  modified_base (265)..(265): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccaccagcctccagggaaggggctggagtgggtggccagcaattaaaccaagatggacgtagaaaaatactatgtggactctgtgaagggccattcgccatcncaganacaacgcaagaactcactgtggctgcacatgaacggcctgagaggcgacgacacggctgtgtacttctgtgcgagacgcccccagtgaggctacgaggtggganctacgtactttgactacggtcggggaccgaacgggaacccgtggtaccaccgtcctcctcacgccctccaaccgaacgggcccacgtccggttcccttcccccgtcggcccacccctcctaccaacgacgcctaccgtcggtcggggccacgacggccggcccggtgggcctcggccgtcgggtaccgaaacggtaccttaaccgttccgacggttcgacgttaccggacgtacggaccgggg

SEQ ID NO: 398718 - DNA, 576 bp, Homo sapiens
  misc_feature: GZ8MTXP02IQ4MN.38.4.A04.1.454.CMB.2.raw
  modified_base (291)..(291): a, c, t, g, unknown or other
  modified_base (303)..(303): a, c, t, g, unknown or other
  modified_base (465)..(465): a, c, t, g, unknown or other
  modified_base (495)..(495): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaacgtggtggagtcgtgggggaggcttggtccgaggcccgggggggtccctggagactctcctgtgcagcctctgcattcacctttagtaactatttaangagctgggtccnccgagcctcgaaggggaggggctgggaggtgggcggcccaggcaattaaaccaagagtaggaccgtaagaaaaatcgtaatggtgactcgtgtaggaaggggcctaagttcgacctatcctaccagaacgaacaacgacccaaagaactcactgtgctgcanagtgaacgctgagacggcgacgacgacggntgtctacgtcgtgtcgacgtacggccgaccccctagtcggaacgggctaaacggcggtaggggactaccgttacggtaacg

SEQ ID NO: 398719 - DNA, 570 bp, Homo sapiens
  misc_feature: GZ8MTXP02I14OK.38.4.A04.1.454.CMB.2.raw
  modified_base (315)..(315): a, c, t, g, unknown or other
  modified_base (326)..(326): a, c, t, g, unknown or other
  modified_base (364)..(364): a, c, t, g, unknown or other
  modified_base (418)..(418): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccattcgcatctcagagacaacgcaaagactcactgtgctgcacatgaacggcctgagaggcgagacacggntgtgtacttcngtgcgagacgcccccagtgagggtctacgagtggggancgtacgtactttgacctcgtggggccagggaaccctggtcaccgtctcctcacncctccaccgaacgggcccagtccgtcccttcccccgtcgcctaccccgtcctaccaacgtacgccaccgtcggtcggggccacgacggccggccgttcgggctcgccgtcggtaccaaggacctcgtccacgtcacgtcgtacgtcggacgg

SEQ ID NO: 398720 - DNA, 620 bp, Homo sapiens
  misc_feature: GZ8MTXP02IGMWO.38.4.A04.1.454.CMB.2.raw
  modified_base (322)..(322): a, c, t, g, unknown or other
  modified_base (372)..(372): a, c, t, g, unknown or other
  modified_base (516)..(516): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaaccaagatggacgtagaaaaatactatgtggactctgtgaagggccgattcgccatctcagagacaacgccaagaactcactgtggctgcacatgaacggcctgagaggcgacgcacggntgtgtacttctgtgcgagacgcccccactggacgggctacgaggtgggancgtacgtacgtttgaacctcgtcgggggccgaaggggaacccctggtcctaccgtctccctccgacgccctacccacgaaacgggcccacgtccggttccctttcccccgcggcccctacccccttccgtaccccaaggacccnccgtaccgtcggcggggaacacgccggtaccggcccgtcgggccgtcgccgtacggtacgaacggtacttaaccgttccgacgtcgacgtccgacgtacggcgg

SEQ ID NO: 398721 - DNA, 554 bp, Homo sapiens
  misc_feature: GZ8MTXP02IZ4VS.38.4.A04.1.454.CMB.2.raw
  modified_base (317)..(317): a, c, t, g, unknown or other
  modified_base (383)..(383): a, c, t, g, unknown or other
  modified_base (400)..(400): a, c, t, g, unknown or other
  modified_base (404)..(404): a, c, t, g, unknown or other
  modified_base (458)..(458): a, c, t, g, unknown or other
  modified_base (480)..(480): a, c, t, g, unknown or other
  modified_base (488)..(488): a, c, t, g, unknown or other
  modified_base (496)..(496): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtggggggaggcgtttgggtcccgagggccccgggggggtccctggagaccttcctcctggtgcagccctctgcattcacctttagtaacttattaatgagctgggtccnccagcctccgagggaaggggctggagtggggtggccaggcacttaaaccgaagagtggaaccgtanaaaaatctatgtgactntggngaaacgggctatcgcatctcagagacgaccgaccaaagactcactgtgctgcanagtgacggctgagagcgacganacggctgngtacttcngtgcgacgaccgccccacgtgaacggggactacgcggtaggcgtacgtaacgttaccg

SEQ ID NO: 398722 - DNA, 558 bp, Homo sapiens
  misc_feature: GZ8MTXP02GVZ6K.38.4.A04.1.454.CMB.2.raw
  modified_base (261)..(261): a, c, t, g, unknown or other
  modified_base (292)..(292): a, c, t, g, unknown or other
  modified_base (303)..(303): a, c, t, g, unknown or other
  modified_base (349)..(349): a, c, t, g, unknown or other
  modified_base (435)..(435): a, c, t, g, unknown or other
  modified_base (446)..(446): a, c, t, g, unknown or other
  modified_base (466)..(466): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggaggtcgttggtccgagggcccgggggggtcctggagtctctcctgtgcngcctctgcattcacctttagtaactattaangagctggtccncagcctcgagggaggctggagtggtgcagcaataacagatgactanaaaatcagtgtgactgtgtaggaaggcctattccgctactctaccaagacaacgaacgacccaaagacctacacgtgtgctgacanagtagaccgcngagacggcgacgacgacggntgtcgttacttcgtgtacggcgacgacccgacccccgtagtagggaacggtacgttaacgtacggggtggacgaccgttaacggtttaaccg

SEQ ID NO: 398723 - DNA, 557 bp, Homo sapiens
  misc_feature: GZ8MTXP02JN48C.38.4.A04.1.454.CMB.2.raw
  modified_base (359)..(359): a, c, t, g, unknown or other
  modified_base (362)..(362): a, c, t, g, unknown or other
  modified_base (366)..(366): a, c, t, g, unknown or other
  modified_base (478)..(478): a, c, t, g, unknown or other
  modified_base (481)..(481): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaaggccgattcgccatctccagagacaacgcaagactcactgtggctgcacatgaacgcctgagaggcgacgacacggctgtgtacttctgtgcgagacgcccccagtgagggctaacggnggngganctacgtcttagacgtagtcggggcctacgggaccctggtcctaccgtctccgtcacgccctaccgaaccgacggtcctacgtccgtcctcccgcgacctccctccacaagcnccncgtcgcgggacacgcgtccggcgtacggctcgcgtacgacgacgtactaaccgtcgacgtcgacacgacgtcggcg

SEQ ID NO: 398724 - DNA, 683 bp, Homo sapiens
  misc_feature: GZ8MTXP02FQJNO.38.4.A04.1.454.CMB.2.raw
  modified_base (323)..(323): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtcggtggggggaggcgtttgggtcccgacggggcccggggggggttccctggacgaccttctcctgtgcagcctctgctattccacctttagaacttattaatgagcgtgggtcccncacgcctccgaggggaggctggaggtggggtggcccagctaacttaaaccaagtcgtaggaacccgtaagaaaaacttactaagtgtacggtactcgtaggtaggaaacggggtccctagttccgacctatcctcagagaaccaaacgaccaaacgaactacaacgtggtacgctcggaccaacgtaacgtacgaaccgggtcccgtagggacggaacgggacggaacgaccgaccggtcgtacgttcgttaccgttcgtacggttcggaccggacggacccgaccccccgtaggtacgggaacggggtaccgtaaccggtaaggggtcgggtaacgtacggttaacccggtttaaccgg

SEQ ID NO: 398725 - DNA, 656 bp, Homo sapiens
  misc_feature: GZ8MTXP02JOG63.38.4.A04.1.454.CMB.2.raw
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttctgtctgcatctgtaggggacagagtcaccatcacttgccgggcagtcaggcattaggactcgttagcctggtatcagacaaaaaccagggaaacgccccctaacctcctgatctagtggtgcatcctattttgacgtaaaaggtcggggtccctaagtacgtaaaggttcaaggccggccgaggtggacttcggtagggaacaggtactttcaagtcctaccgaacaaagtcaacggcaacgccctgaccaaggcccgtagggacgactaacgtgaccttaaacgtttattacttcgtacgtacagtacctttaaacgtacccgttaaccccctacgttacgttttacgggaccgtaacgggggtaaaccctaagggtttacggaacttaaacgtaaccgtaaaaccggttaaacgttcgggtaacggtcccgttacgaacctacccgtaatccgtttacgttccctttacgtacctttcccccg

SEQ ID NO: 398726 - DNA, 605 bp, Homo sapiens
  misc_feature: GZ8MTXP02GT0CV.38.4.A04.1.454.CMB.2.raw
  modified_base (278)..(278): a, c, t, g, unknown or other
  modified_base (364)..(364): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctggagtgggtgccagcattaaccaagatggactagaaaaatctatgtggactctgtgaaggccgattcgcatctcagagacaacgccaagactcactgngctgcacatgaacggctggagaggcgaacgacacggctggtgtacttctggtgcgaagaccgtcccccaagtggacgggctaacgngggtcgggaatccgtaacgacttttgaacctacgtgggggacccaaagggtaaaccctggtacctacccgtctccctcacgccctacccaccgaaacggcccaacgtccggtcccttcccccgtcggcccaccccttcccaccaaacgacgaccacctcgcgggggccaacgacggtcccggccgtcggggctcggccgttcgacaacggacctaaccttccgacgtgactcgacgtcgcg

SEQ ID NO: 398727 - DNA, 577 bp, Homo sapiens
  misc_feature: GZ8MTXP02JNABC.38.4.A04.1.454.CMB.2.raw
  modified_base (277)..(277): a, c, t, g, unknown or other
  modified_base (332)..(332): a, c, t, g, unknown or other
  modified_base (359)..(359): a, c, t, g, unknown or other
  modified_base (361)..(361): a, c, t, g, unknown or other
  modified_base (365)..(365): a, c, t, g, unknown or other
  modified_base (417)..(417): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaagggctggagtgggtggccagcattaaccaagatggacgtgaaaaatctatgtggactctgtgaagggccgattcgccatctcagagacaacgccaagactnactgtggctgcacatagaacggcctgagaggcgacgacacggctgtcgtacttcngtgcgagacgccccagtgaggctaggngnggancgtacgtctagacgtagcgggacacggaccgtcgtacaccgtctctacgacnccaccaaccgacgaccacgtccgtccttcccgtcgtcctaccctacctaccaacgacgaccgaccgtcggacggggcacgacggtccggccgtcgggcgtcggccgtacggtaccgtaacggtacttaacgtaccgacgtacgacgtacgacgtacgcgg

SEQ ID NO: 398728 - DNA, 708 bp, Homo sapiens
  misc_feature: GZ8MTXP02FZFNB.38.4.A04.1.454.CMB.2.raw
  modified_base (277)..(277): a, c, t, g, unknown or other
  modified_base (309)..(309): a, c, t, g, unknown or other
  modified_base (323)..(323): a, c, t, g, unknown or other
  modified_base (392)..(392): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgttgggttttccttgttgcttattttagaaggtgtccagtgtgaggtgcaagtggtggagtcggtgggggaggtcgttggtccgacgggtcccgggggggtccctggacgtcttctccgtgtgcagccttcngctattcaaccttttagtaaacttatttaaangagtctgggtcccncagccctcggaggggacggggctgggaggtggggtggccagactaataaaccgagagtggaaccgtaanaaaaattcgtaattggtcgacttcgtgtagggaaaggggtcccagtttccgaccaagttcccaccgaagacgaaaccgaaaccgacccgtaaaacggaaccttacgaacgttgggtacgacgttacgaccgaactaacgttacggaaaccggtacccggtaggaaaccggacgggacccgggaaaccgacggaacccggggtcttacgggtttcgtttaacccggtttcgtgggttcggacggtaaccgacccgacccccgtagtaggggaacggtacgaccggtaacgggtgggacgtacgttacgtttaaccgg

SEQ ID NO: 398729 - DNA, 598 bp, Homo sapiens
  misc_feature: GZ8MTXP02FPBAG.38.4.A04.1.454.CMB.2.raw
  modified_base (252)..(252): a, c, t, g, unknown or other
  modified_base (259)..(259): a, c, t, g, unknown or other
  modified_base (287)..(287): a, c, t, g, unknown or other
  modified_base (389)..(389): a, c, t, g, unknown or other
  modified_base (412)..(412): a, c, t, g, unknown or other
  modified_base (456)..(456): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaactggtggagtcgtgggggagcttggtccaggccggggggtcctgagacctctcctgtncagcctngcattcacctttagtaaacttatttaangagcgtcgggtccctccacgcctaccggaggggacggggctggaggtggggtgccgagctataaaccgagatggacctaagaaaatactatggtacgctcgngtaggaagggcctatcgccatcncagacaacaacgaccaaagacctcaacgtgtacgctgacaacgntacggacggtccagacgacggcgaacgacgacgctgtagttacgttcgtggtacgcgtaacggaccccgtaccccccgaggttacggaacgggaccgttaaccggtaggggcggggtaactaccgttaacggtttaacccgg

SEQ ID NO: 398730 - DNA, 563 bp, Homo sapiens
  misc_feature: GZ8MTXP02ITF3O.38.4.A04.1.454.CMB.2.raw
  modified_base (294)..(294): a, c, t, g, unknown or other
  modified_base (401)..(401): a, c, t, g, unknown or other
  modified_base (423)..(423): a, c, t, g, unknown or other
  modified_base (492)..(492): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggagcttggtccagccggggggtcctgagactctctgtgcagcctctgcattcacctttagtaaactattaatgagtctgggtccnccaggcctccgagggaaggggctggagtggggtggcccagcataaaccaagatggaaccgtgaaaaaatctaatgtggactctgtgaaggggccagttcgccaatcnccagagacaacgccaaagactnactgtagctgactaacagtgaaccggctagagaggcgacgaacacggggcctagggtgttaaccgtttntacggtcgacgaacgacccgaccccctagtacggaacgggtactaacgacggtgggaacgtactacggtac

SEQ ID NO: 398731 - DNA, 871 bp, Homo sapiens
  misc_feature: GZ8MTXP02GR409.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagtcttgggttttccttgttgcttattttagaaggtgtccagtgtgaggtgcaacgtggtggagtcggtgggggagtcgttgggtccgaggggcccgggggggtccctggacgtaccttccgtccgtggtcgcacgtccctctgctactttacctaaccttttaagtaacttaatttaacgtggaacgtccgtcggggtcccgacccctacggcccctaccgggaagggggaacggggtccgtaggggagggttggggtcggacccgagacctaaacgttaaaccgaaggtagtacgggaaacccgtaaagtaaaaaacttctaaagttcggtacggtaacttcggttagggtacgggtaaaccgggggtcccgtaacgtttcccggacctacgttacccgtaccgaaacggaaccgaaaccgaaacccgaaacccgtaaaacgtaacccgtaccgtaaccggttgggtaccggtaccgttacgggaccaaacccgtaaggtaaccggggtaacccgggtacccggtacgggaacgggaccgggggaccggtaaccgggaaccggtaccgggtacgttacggtttacggtttaaccgtttaccggttggtaccggtaccgggaaaccggacccccggtaccccccgtagggttaaccgggaacgggggttacccgtaacgggttacggggtacggggtaaccgttaccggtttaaccgtttaaccgggg

SEQ ID NO: 398732 - DNA, 599 bp, Homo sapiens
  misc_feature: GZ8MTXP02JM7M9.38.4.A04.1.454.CMB.2.raw
  modified_base (301)..(301): a, c, t, g, unknown or other
  modified_base (314)..(314): a, c, t, g, unknown or other
  modified_base (542)..(542): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcggtgggggaggtcttgggtcccgagggcccgggggggtccctggagacctctccgtgtgcacgcctctgcattcacctttagtaacttattaangagcgtcggtccnccagcctccgaggggagggctggaggtgggtggacccagctaacttaaccgaagatggaaccctagaaaatctagtgtggactgtagaggaacgggtccgtattccggacactccgtacaggaacgacaaaccgacccgaaagaacctcaacgtggtacggctagccacacgttaggaaccggccgtagacggaggaccgacgtacacggtctggtacgttacttcgngtcgacgtacgaccgccccagtggaacggactacggaggtggacgacgtacgttacg

SEQ ID NO: 398733 - DNA, 586 bp, Homo sapiens
  misc_feature: GZ8MTXP02FS9FK.38.4.A04.1.454.CMB.2.raw
  modified_base (339)..(339): a, c, t, g, unknown or other
  modified_base (378)..(378): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccaggggaaggggctggagtgggtggccagcattaaaccaagatggacgtagaaaaaatactatgtggactctgtgaagggccattcgccatctccagagacaacgccaaagaactcactgtggctgcacatgaacggcctggagaggcgacgacacggctggtgtacttntgtgcgagacgcccccagtggagggctacgagtggggancgtacgactttgactacgtggggaccaaggggaaccctggtcaccgtctcctcagcatccaccgaaacgggccctagtccggtccttcccccgtgccctacccctctacccaagcgcaccgtcgacgggggcacgacgccggccgtcgggcctcggcccgtggacgtaaacggtaaccttacgttacccgaggttcacgtcggactgg

SEQ ID NO: 398734 - DNA, 587 bp, Homo sapiens
  misc_feature: GZ8MTXP02FMQ9T.38.4.A04.1.454.CMB.2.raw
  modified_base (271)..(271): a, c, t, g, unknown or other
tcagtcgatcacgtcacgaccggtgctcgatttagagtagtgatcagggggagtcagtcccagtcaggacacagcatggacatgagggtccccgctcagctcctggtgctcctgctgctctggctcccaggtgccggatgtgacatccagttggcccagtctccatccttcctgtctgcatcgtggtaggggacagagtcaccatcacttgccgggcagtcagggcagttaggacttcgttagcctggtatcagacaaaacgagggaaacncccctaactcctgatctatggtgcatacctattttgactaaaggtcggggtacccagtacgaaggttcgagcccggacaggtggatcgtagggacagtaatcagtctacaacatcagcacgcctgcagccgtaggagaacttacgagtactaaatttattaattcgtactaacagtacttaaactaccgttaaccccagttacgtttcggaccgaaggggtaacctaaggttacgggacgtaacgtaaccgaaaacgtacgttacggtcggtactcgtaccgtaactacgttccttacgttaccttactttacccg

SEQ ID NO: 398735 - DNA, 665 bp, Homo sapiens
  misc_feature: GZ8MTXP02JYLGF.38.4.A04.1.454.CMB.2.raw
  modified_base (356)..(356): a, c, t, g, unknown or other
  modified_base (364)..(364): a, c, t, g, unknown or other
  modified_base (387)..(387): a, c, t, g, unknown or other
  modified_base (660)..(660): a, c, t, g, unknown or other
tcagtcgatcacgtcacgaccggtgctcgatttagagtagtgatcagggggaagacccgatggggcccttgggggaggcttggtccagccgggggggtccctgagactctcctgtgcagcctctgcattcaccttttagtaactatttaatgagctgggtcccgcagcctccgaggggaaggggctgggagtgggtggccagcattaaccaagatggacgtagaaaatctatggtggactctggtgaagggccgtattcgccatctccagagaacaacgcaaagaactcactgtggctgcacagtcggaacggcctggagacgggacgacgacacggcttggtagttacttcgtgngcgagccncccccagtggagggcctaacggnggtcggggacccgttaacgtacgttttgaccgttacgggtcggggaccgtaacggggaacccgtgggtaccacccgtcctccaccgacgccccgtaccaccggtaaccgggccctacgttcccggttccctttcccccggcgtaccccacccctcctacccgaaacgcccgaccgttacccgcggtcggggaccacgacggttccggcccgtggggccttcggaccgtacggacgaaacgccttaacgtccgaacgttcgacgacgtaccggnggccg

SEQ ID NO: 398736 - DNA, 604 bp, Homo sapiens
  misc_feature: GZ8MTXP02FGSR9.38.4.A04.1.454.CMB.2.raw
  modified_base (235)..(235): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggactagaaaaatctatgtggactntgtgaaggccattcgcatctcagagacacgcaaagactcactgtgctgcacatcgaacgctgagaggcgacgacacggctgtgtactctgtgcgagaccgcccccagtggagggctacgaggtggggactctacgtactttgacctacgtcgggggaccaacgggaacccgtggtaccctacccgtctccctcaccgccctacccgaaccgaacggtcccacgttcccggttcccttcccccgcggtccctacccctaccctaccaaacgacgcccaccgttcggcgggggaccacgacggccggcccgtgggcctcggcctcggtacaacggtacctaaccgtaccacgtcgacgtcgacgtggacgg

SEQ ID NO: 398737 - DNA, 601 bp, Homo sapiens
  misc_feature: GZ8MTXP02HZ438.38.4.A04.1.454.CMB.2.raw
  modified_base (255)..(255): a, c, t, g, unknown or other
  modified_base (258)..(258): a, c, t, g, unknown or other
  modified_base (263)..(263): a, c, t, g, unknown or other
  modified_base (294)..(294): a, c, t, g, unknown or other
  modified_base (306)..(306): a, c, t, g, unknown or other
  modified_base (337)..(337): a, c, t, g, unknown or other
  modified_base (499)..(499): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaatgggtggagtcgtgggggagcgttggtccgagggcccggggggtccctgagactctcctgngcngcctntgctattctacctttagtaaacttatttaangagcgtgggccnccagccctcgaggggagggctggagtgggtncccagcaattaaacaagagtaggtacctaagaaaaattctaagtggtaggtctcgttgggtacggaaacgggggtcctagttccgacctacgtcctacagacgaacgaaaccgacccgaaaagaacctcaacgtggtcgctgacaccagtacgacggtccgngaggacggcgacgacgacgcgtgtacgttacgtcgtggtcgcggacgcccgacccccgtagtacggaacggcgtacgaggtcgggacgtacgtacgttaccg

SEQ ID NO: 398738 - DNA, 554 bp, Homo sapiens
  misc_feature: GZ8MTXP02FFZL6.38.4.A04.1.454.CMB.2.raw
  modified_base (260)..(260): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcttggtccaggccgggggggtccctggagactctcctgtgcagcctntgcattcacctttagtaactatttaatgagctgggtccgcagcctccgagggaaggggctggagtgggttgccagctaattaaaccaagatggaccgtagaaaaaatactatgtggaactctgtggaaggggccaagttcgaccatctccagaacgacaacgaccaaagaacctcaactgtaggctgcacatagaaacggcctagacgaggcgaacgacgacggctgtgtacttcgtgtcgcgagaccgaccccagtggaacggactaacgaggtgggacgacgtacgtaaccg

SEQ ID NO: 398739 - DNA, 808 bp, Homo sapiens
  misc_feature: GZ8MTXP02I533U.38.4.A04.1.454.CMB.2.raw
  modified_base (253)..(253): a, c, t, g, unknown or other
  modified_base (261)..(261): a, c, t, g, unknown or other
  modified_base (265)..(265): a, c, t, g, unknown or other
  modified_base (305)..(305): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgagtgcaactggtggagtcgtgggggagcgttggtccgagggccggggggtcctgagacctctcctgngcagcctntgcnttactaccttagtaactattaatgacgtcgtacgggtccnccgaacgccctaccggaaggggaaggggcgtggggtaggtggggtcggaccgaggctaaattaaaccgaaggacgtaggaaccgtaaggaaaaaattactagtaggttacggacttcgtagggtaggaaaccgggggtaccgtaacgttccggtaccctacgttacccgttaacccgaaacgggaaacgtaaacccgaaaacccggtaaccccgaaaacggtaaaccctaccgtaaacccggttgggttacgggaccgttacgggtacccaaaacggtaacgttaccgggaaaccgggtcccggttaaacggggaacgggaaacggggacccggtaaacggaacccggtaaccgggtctttacggggtaccgttttaacgttccggtttagggtaccggaaccggttaaacgggacccccgtaccccccgaaggttacggggaaacggtaccggtaaccggtagggggaccgggtaaccgtacggttaaccggtttaacccgg

SEQ ID NO: 398740 - DNA, 621 bp, Homo sapiens
  misc_feature: GZ8MTXP02GJJKC.38.4.A04.1.454.CMB.2.raw
  modified_base (277)..(277): a, c, t, g, unknown or other
  modified_base (301)..(301): a, c, t, g, unknown or other
  modified_base (381)..(381): a, c, t, g, unknown or other
  modified_base (576)..(576): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctggtaggggacagagtcaccatcacttggccgggccagtcagggcagttaggacttcgttagccgtggtatcgagaacaaaaaccgagggaaacnccccctaactcctgatctatggtnctatcctagtttgacgtaaggtcgggtacccagtcgaaggttcaggcgcagtgatcgtaggacagtattcagtctacaanaatcagcacgtccctgacgtagccgtagggaacgtactacctagtaccttaaattttagttactttgtaccttaatagttacctttaaacttacccgttaaccccctaagtttaccgttttacggaccggtaaacggggtacctaaagggtttaggaaacgtactaaaccgtaaaacggtacgttcggtacggtnacgtaacctaacctattccgttcgtacctttctaccgtttccccg

SEQ ID NO: 398741 - DNA, 577 bp, Homo sapiens
  misc_feature: GZ8MTXP02FGLT8.38.4.A04.1.454.CMB.2.raw
  modified_base (260)..(260): a, c, t, g, unknown or other
  modified_base (286)..(286): a, c, t, g, unknown or other
  modified_base (367)..(367): a, c, t, g, unknown or other
  modified_base (379)..(379): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccaggccgggggggtccctggagactctcctgtgcagcctngcattcacctttagtaactatttaangagctgggtccgccagcctccgaggggaaggggctggagtggggtgccagcaattaaccaagatggaaccgtagaaaaatntatgtggactcngagaagggccgattcgacatctccagagacaacgacaaagactcacgtgtagctgcacagtagaaccggctaggagacggcgaacgacggacggtcgttgtacgtacttcgtggtcggccgaacggacccgaccccccgaacggtcggaacggggactaaccggtagggtcggggtaacgccgttaacggttaacccg

SEQ ID NO: 398742 - DNA, 735 bp, Homo sapiens
  misc_feature: GZ8MTXP02HU87G.38.4.A04.1.454.CMB.2.raw
  modified_base (162)..(162): a, c, t, g, unknown or other
  modified_base (195)..(195): a, c, t, g, unknown or other
  modified_base (286)..(286): a, c, t, g, unknown or other
  modified_base (295)..(295): a, c, t, g, unknown or other
  modified_base (337)..(337): a, c, t, g, unknown or other
tcagtcgatcacgtcacgaccggtgctcgatttagagtagtgatcagggggaagaccgatgggcccttgggggaggcttggtccagccgggggggtccctgagactctcctatgcagcctctgcattccaccttttagtaactatttaatgagctgggtccncagcctcgagggagggctggagtgggtgccaanattaaccagatggacgtagaaaaatctatgtggactctgtaggaacgggccattcgcctatctaccagacgacaacgccaagactcactgngctgcacangaacgctaggagacggcgacgacgcggctgtcgttacttcgngtcgacggacgtaccgcccccgtaagcgggacgggaccttaacggaggggtaggggacgtccgttaaccgttcgttttacggacccgttaccggggtacgggggaccccgaaacggggttaacccccgtgggtacccgtacccggttccttcccctacggacccgtcccttacccccgaaaccggaccgggtacccctacggttccccgtttccccttcccccgtcggacccccttaccccttacccaccgaaacgtccgacccacccggttcggggacggggaccaaccggccgggccccggtccggtcgggtcctccggtccggttacggtaccgaaaccggttacccttaccgttaacccgtgaacgttccgaacggttcggacggccggtacgg

SEQ ID NO: 398743 - DNA, 597 bp, Homo sapiens
  misc_feature: GZ8MTXP02JUHJ0.38.4.A04.1.454.CMB.2.raw
  modified_base (312)..(312): a, c, t, g, unknown or other
  modified_base (459)..(459): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaggtgtccagtgtgaggtgcaacgtggtggagtcgtgggggagtcgttgggtccgagggtcccgggggggtccctggagacctctcctgtgcagcctctgcattccacctttagtaaacttattaatgagcgtgggtccnccagcctcgagggaggggctaggaggtgggtgccctagactaattaaaccaagataggaaccgtaagaaaaactctagtgtggacttcgtgtaggaaacggggtccaagttcgaccattccacaagagaaccaacgaccaaagaccncacgtgtacgctacggcaacgagtacgaaaccggtccgaggaacggacggacgacggtacgaccggtctgtcgttactcgtggcgacggacgcccgcccctagtcggaacgctacggcggtaggacacgtacgttacg

SEQ ID NO: 398744 - DNA, 834 bp, Homo sapiens
  misc_feature: GZ8MTXP02IVLDL.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgatcacagaggactcaccatggaattggggctgagcttgggttttccttgttgcttattttagaaggtgtccagtgtggagtgcaacgtggtggagtcgtgggggaggtcgttggtccgagggcccggggggtccctggaggtactctccgtgtcgcacgcctctgctattcctacctttagtaaacttatttaatgacgtcgtacgggtcccctccgacgcccctaccggaaggggacggggcgtaggggaggttcggggacggacccgaaggacctaaacgtttaaaaccccgaaggtaagttacgggaaaccccgttaaaggtaaaaaaaacttaccgttaaaggttaggtacgggtaaaccctttcgggttagggttaaacgggggaaccgggggtaccccgtacgtttacccggaaccctaacgttacccttacccgaaagggaaccgaaaacccggaaaccgtaacccgaaaaacggtaacccttagaaaccccggttgggttacggccttacggtacccaaacgtaacggtttaaccggaaacccgggtaccgttaacgggaacggaaccggggacccgttaaaccggaaccggaccggttacgtcggtacgttttacgttccgttgggcgtaccggaccggtacccccgacccccggaagttacggggaaccggtacgtaacggaccgggtagggacgtaccgttaacgtttaccgg

SEQ ID NO: 398745 - DNA, 715 bp, Homo sapiens
  misc_feature: GZ8MTXP02HRKX6.38.4.A04.1.454.CMB.2.raw
  modified_base (254)..(254): a, c, t, g, unknown or other
  modified_base (260)..(260): a, c, t, g, unknown or other
  modified_base (547)..(547): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgagtgcaacgtggtggagtcgtgggggagcttggtccaggcccggggggtcctgagctctcctgtgcngcctcngcattcacctttagtaacttatttaatgagtcgtcgggtcccaccgacgccccgtaccggaaggggaacggggcgtaggggtaggttggggtcggcccgaggactaaactttaaaacccgaagagttaggaaccgttaaagtaaaaaattcgttaagtggtacggtaaccttgttgggtacggaaaggggccccgttaagttcccggacctactaccttacccgaaggaaacgaacccgaaaccgaccttaaaacgaacctcgtaaccgtgtacggctaggacccanaacgtacggaaaccgttccgaaggaacggacggaccggaaaccggaaccgtaccgggttcgttacggttacgtttacgttcggtaggccgaaccggaccgacccgaccccgtacggtacggaacggtacctacgggtcggtacggtaccgttacgttaaccggttacg

SEQ ID NO: 398746 - DNA, 646 bp, Homo sapiens
  misc_feature: GZ8MTXP02GPJHR.38.4.A04.1.454.CMB.2.raw
  modified_base (290)..(290): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactgggtggagtcgtgggggaggcttggtccaggccggggggtcctggagactctcctgtgcagcctctgctatctacctttagtaactatttaangacgtcgtggtacccgcctacgccgtccgaggggaacggggtctgggaggttggggtcgcccgagtactaaacgttaaaaccgaaaggtatacggggtaacgtaaagaaaaaacgttctaagtcggtaggaccttcgtggtacgggaaacggggcccgtaagttccgactaactccgtaccgagaacgaacaaaccgaccaaaacgtaacctacaaccgttgaggtcccgagacctacagtacgaaccggccagagaggcgaacgacgccgagtcggtacttacgttcgtggacgcggacgaccgacccccaagcggaacggtaccgtacgagggtacggacggtacttaaaccgg

SEQ ID NO: 398747 - DNA, 581 bp, Homo sapiens
  misc_feature: GZ8MTXP02FGL9S.38.4.A04.1.454.CMB.2.raw
  modified_base (283)..(283): a, c, t, g, unknown or other
  modified_base (306)..(306): a, c, t, g, unknown or other
  modified_base (334)..(334): a, c, t, g, unknown or other
  modified_base (369)..(369): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccagggaaggggctggagtgggtggccagcattaaccaagatggactagaaaaatctatgtggactctgtgaagggccattcgccatctccagagacaacgccaagactcactgnggctgcacatgaacggcctgagnggcgacgacacggctgtgtactctggtncgagccgcccccacgtggaggctacgagtgggacnctacgatttgactacgtggggccagggaacccgtgtcaccgtctctcgacgcctccaccgacggcccacgtccgtcctccccctcggcccaccctcccctaccgaacgacgccacccgtcgacgggggccacgacgccggcccgtcggggcctcgccgtcggtaccgaacggtacctaaccttaccgacgtacgacgtacgacgcggacggg

SEQ ID NO: 398748 - DNA, 577 bp, Homo sapiens
  misc_feature: GZ8MTXP02IAI9F.38.4.A04.1.454.CMB.2.raw
  modified_base (294)..(294): a, c, t, g, unknown or other
  modified_base (304)..(304): a, c, t, g, unknown or other
  modified_base (356)..(356): a, c, t, g, unknown or other
  modified_base (556)..(556): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtgggtggagtcgtgggggaggcgttggtccgagggccgggggggtcctggagactctcctgtgcagcctctgctattcactttagtaactattaatnagctcggccnccagcctcgagggaggggctggagtgggtgaccagcaattaaaccaaaggtntggaaccgtaagaaaaatactagtgtaggacttcgtgagagggccattcgcctatccctacgagacgacaaaccgaccaaataacctcactggtcggactgaccacgtagtacggaaccggccgtaggacggaggaccgaacggacacggcttagtcgttacttcgtgcgcggacgcccgcccagtcggaacggctacgnggtacggcgtacgtacgtacg

SEQ ID NO: 398749 - DNA, 647 bp, Homo sapiens
  misc_feature: GZ8MTXP02JZ8GC.38.4.A04.1.454.CMB.2.raw
  modified_base (258)..(258): a, c, t, g, unknown or other
  modified_base (263)..(263): a, c, t, g, unknown or other
  modified_base (294)..(294): a, c, t, g, unknown or other
  modified_base (311)..(311): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgagggcccggggggtccctggagactctcctgtgcngcctntgctattcctacctttagtaacttatttaangacgtcgtcgggtcccnccagcccctccggaggggacggggctggaggtggggtcggcagcaagttaaccaagagtaggaccgtaagaaaatactagtgtaggctcgtgtagggaacgggccgtatccgaccatccctaccgaagacgaaccgaaccgaccgaaacgacctaccaacgtcgtcggcttacgaccaactagtaccggaacggccgtaggaggacggaccggaacggaccgacggtctaggtctttaaccgttcgtggtccggtacgaccggtacccgaccccccgtgtacggggaacggtaccgtaacggtcgggtacggtaacgtccggtaaaccgtttccgg

SEQ ID NO: 398750 - DNA, 761 bp, Homo sapiens
  misc_feature: GZ8MTXP02JVB0I.38.4.A04.1.454.CMB.2.raw
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccgagggaaggggctggagtgggtggccagcattaaccaagatggacgtagaaaaatctatgtggactctgtaggaagggccgattcgccatctcagagacaacgccaagaactcactgtggctgacacgatacggaaccggcctaggaagacgggaccgacgaccgacggcttggttcgtactttcgttggcggacgaacggacccgaccccccgagtcgggagggaccttacggagggtggggaactcgtaaccgtacgtttttcggaccgttacgggtacgggggaccgtaaccgggggtaacccgttgggttcccgtacccgttccgtcccgttaccgaccggtacccctacccgaacccggaaacgggtccccctaacggttcccgggttccccctttccccccgtaccggtaccccacccccgttccccgtacccaaacggacgtacccctacccggttccggtacgggggacccaaccgaccgggtcccgggaccccggtcggggcccttaccggcccggtacggttaccgaaacggttacctaaccgttacccggtacgtccgtaacgtcgaccgtagggaccggg

SEQ ID NO: 398751 - DNA, 654 bp, Homo sapiens
  misc_feature: GZ8MTXP02ISUBX.38.4.A04.1.454.CMB.2.raw
  modified_base (193)..(193): a, c, t, g, unknown or other
  modified_base (267)..(267): a, c, t, g, unknown or other
  modified_base (306)..(306): a, c, t, g, unknown or other
  modified_base (324)..(324): a, c, t, g, unknown or other
tcagtcgatcacgtcacgaccggtgctcgattttagagtagtgatcagggggtctcagagaggagccttagccctggactccaaggccttttccacttggtgatcagcactgagcacagaggactcaccatggaattggggctgagcttgggttttccttgttgcttattttagaaggtgtcagtgtgaggtncaactgggtggagtcggtgggggagtcgttggtccgaggggcccggggggtccctggagacctctcctgtcgcncgccgttctgctattactactttagttaacttatttaangacgtcgtcgggtccccnccgacgcctacggaaggggacggggcgtgggaggttgggtcaccagtactaacgttaacgagagtggtaacctaagaaaattctagtggtacgtacttggtggtacgggaacgggtcctagttccggacctacgtcctacgagaaccgtaaccgaacgacccgaaaacgtaacctacgacgttggacggtctacgaccacgtagtacgaccggtcgtaggacgcggacgacgaacgcggtactgttactacgttcgtggtacggcgaaccgtccgaccccgtgacgggtaacggacgtacgaggggtacggacgtacgttacggtttacg

SEQ ID NO: 398752 - DNA, 616 bp, Homo sapiens
  misc_feature: GZ8MTXP02I1U0A.38.4.A04.1.454.CMB.2.raw
  modified_base (261)..(261): a, c, t, g, unknown or other
  modified_base (287)..(287): a, c, t, g, unknown or other
  modified_base (299)..(299): a, c, t, g, unknown or other
  modified_base (428)..(428): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagtcgttggtccgaggccggggggtcctgagctctctgtgcagcctcngctattcactttagtaacttattaangagcgtggtccnccagcctcggagggacggtctggaggtgggtcggccaggactaacgttaaaccaagagtggaaccgtagaaaatctagtcgtacgtaactcgtggtacggaacgggtcctagttccgacctattacccncgaaggacaaaccgaaaccgccgtaaaagaaccgtcaacgttcggcggctacgacctacggacttagggaacccgcgtaggaacggacggaccgaccgtacgacgggctagggtcttacttcgtgacgacgacgccgacccccgagtcgggaacggcttacggaggtcggacgtccgtaacgtttacg

SEQ ID NO: 398753 - DNA, 668 bp, Homo sapiens
  misc_feature: GZ8MTXP02H4NXY.38.4.A04.1.454.CMB.2.raw
  modified_base (292)..(292): a, c, t, g, unknown or other
  modified_base (304)..(304): a, c, t, g, unknown or other
tcagtcgatcacgtcacgaccggtgctcgatttagagtagtgatcaggggaggtctcagagaggagcccttagccctggactccaaggcctttccacttggtgatcagcactgagcacagaggactcaccatggaattggggctgagctgggttttccttgttgctattttagaaggtgtccagtgtgagtgcaactggtggagtcgtgggggaggcgttggtccgaggccggggggtccctgagactctcctgtgcagcctctgctattcacctttagtaacttatttaangagcgtggcccncgacgccgtcgaaggggaacggggctagggaggttggggtcggccgagactaaacgttaaaccgaaagtagtacgggaaccgtaaagtaaaaaacttacgtagttagttacggtacgttcgttaggtacgggaacgggtacccgtagtccgtaccctacgtcctacgaagaacgaaccgaaaccgaccgaaactaacctacgaaccgttgtcggtacctacgcaactacgttacgggaaacggtccgtaggacggaacgggaccgaacgtacgacggtacttcgtcgtaccgtttgagtcgacgaccgaccgtacccccgagtaacggacggtacgtacggaggtacggagtaccgtttaacgg

SEQ ID NO: 398754 - DNA, 645 bp, Homo sapiens
  misc_feature: GZ8MTXP02HRFUW.38.4.A04.1.454.CMB.2.raw
  modified_base (262)..(262): a, c, t, g, unknown or other
  modified_base (302)..(302): a, c, t, g, unknown or other
  modified_base (348)..(348): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctattttagaaggtgtccagtgtgaggtgcaactggtggagtcgtgggggaggcgttggtccgagggcccggggggtcctggagactctcctgtgcagcctntgctattcacctttagtaactattaatgagctcgggtccncgagcctccgaggggaggctggagtgggtcgcagcataaaccaagntaggacctagaaaaatctagtggtacggtactcgtggtacgaagggccctaagttcgacctatccttaccgaaggaacaaccgaaccggacctaaacggtaaacccttaccgaacgtcggttaccgggcttaggaccgtaaacacgttaagggaacccggcccgttaggaacggacgggaccgacgtaccgaacgggtctacggttacgttccttcgtgtcggaccgacgacccgcccccgaagtcggaacgggtacctaaccggtagggacgggacgtaccgtaacggtttaaccg

SEQ ID NO: 398755 - DNA, 711 bp, Homo sapiens
  misc_feature: GZ8MTXP02JZ2BK.38.4.A04.1.454.CMB.2.raw
  modified_base (265)..(265): a, c, t, g, unknown or other
  modified_base (617)..(617): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaactggtggagtcgtgggggaggcgttggccgagggcccggggggtccctgagactctcctgtgcagcctcngcattcactttagtaacttattaatgagcgtcgggtcccgaccacgtcccgtccgaagggggaacggggctggggacgggttgggggtcggacccgagaccgtaacgtttaaaacccgaaaggtacgtacgggtaacccgttaaagaaaaaagttaccgtaagttaggtacggtacttcgttggtacgggtaaacggggccgtacgttccgacctactccgtacccaaggacgaaaccaaaccggtacccaaacgtaacctccgtaacgtcggtcggacctcgactacaggtacgaaccggccgtaggacgacgggaccgaacgacgacggtcgtggttacttaccgttcgnggtacggaccggaacggtacccgccccccgtaaggtacgggccgggaccctaagggtacgggttacggggaaccgtaccgtacggtttaaccgg

SEQ ID NO: 398756 - DNA, 611 bp, Homo sapiens
  misc_feature: GZ8MTXP02HRBPY.38.4.A04.1.454.CMB.2.raw
  modified_base (261)..(261): a, c, t, g, unknown or other
  modified_base (294)..(294): a, c, t, g, unknown or other
  modified_base (310)..(310): a, c, t, g, unknown or other
  modified_base (572)..(572): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagtcttgggttttccttgttgcttattttagaaggtgtccagtgtgaggtgcaacgtggtggagtcgtgggggagtcgttggtccgagggccggggggtcctggacgctctcctgtgcngcctctgctattctacctttagtaacttattangagtcgtcgggtcccncacgcccgtccggaaggggaggggcgtgggtaggtcggggtcggccgagctaaattaaaccgaagtagtaggaaccgtaagaaaaactactagtgtacggactcgtggtagaacgggtcccgtagttccgctactcctacagacgaacaaccgaccaaagacctctaacgtgtcggctgacacacgtacggaaccgcgtagacggacggaccggaacgacgacggtcgtgtacgttacttcgtgcgacgacgcccgaccccngtcggaacggctacggacggcggacgtcgttacgttacg

SEQ ID NO: 398757 - DNA, 752 bp, Homo sapiens
  misc_feature: GZ8MTXP02JKSBA.38.4.A04.1.454.CMB.2.raw
  modified_base (263)..(263): a, c, t, g, unknown or other
  modified_base (306)..(306): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcttggtccagggcccgggggggtccctggagactctcctgtgcagcctntgctattctacctttagtaacttatttaatgagcgtgggtccnccagcctccgaggggaaggggctgggaggtggggtcgcccgagcaattaaaccgaagtacgtaggaaccgtagaaaaatctaatggtagactcgtagtaggtaaacggggccgtagttccgacctacttcctaccgaacggaacgaaaccgaaaacccggaacccgaaaacggaaacccttaccgtaaccgttacgggttacggaccgtcggacccaacgtaacgttacgggaacccgggacccgttagggaaacgggaacggggacccggaaacggaacccggtaccgggtaccgttcggggttacgtttaaccgtttccggttcggtacgggtaccggaaccggaaccccggtacccccccgtaacggttaccggggaacgggggtacccttaacccgggaaggggttacgggggtacgtacccggtttaaccggtttaaccgg

SEQ ID NO: 398758 - DNA, 660 bp, Homo sapiens
  misc_feature: GZ8MTXP02FHEJS.38.4.A04.1.454.CMB.2.raw
  modified_base (269)..(269): a, c, t, g, unknown or other
  modified_base (337)..(337): a, c, t, g, unknown or other
tcagtcgatcacgtcacgaccggtgctcgatttagagtagtgatcagggggagtcagtcccagtcaggacacagcatggacatgagggtccccgctcagctcctggggctcctgctgctctggctcccaggtgccggatgtgacatccagttggcccagtctccatccttcctgtctgcatctgtagggacagagtcaccatcacttgccggcagtcgagggctagttagactcgttagcctggtatcagaccaaaaacgacgggaacncccctaacctctagatcgtatcgtgcactctatttgacgtaaggtcgggtaccagttacgtagtacgnggcggacagtagatcgagggacaaggtactacagtactacgaactaatcgaacgacgtacgtcccgtagggacgtaccgtagggaacgtaacgttaacgtacgtaacttaaaacgtttagtttaacgtttacgttacttaacgtaacgttaaccgtttaaaacctttacccgttaacccccttaacgttaccggttttacggaccggttaacggggaacctaaagggtttacgaacgtaaactacgtaaaacgtaacgtacggtacgtacgacggtacctaacgtacttctacgttaccttactaccgtttacccgtaccccg

SEQ ID NO: 398759 - DNA, 583 bp, Homo sapiens
  misc_feature: GZ8MTXP02JZN0S.38.4.A04.1.454.CMB.2.raw
  modified_base (304)..(304): a, c, t, g, unknown or other
  modified_base (327)..(327): a, c, t, g, unknown or other
  modified_base (336)..(336): a, c, t, g, unknown or other
  modified_base (350)..(350): a, c, t, g, unknown or other
  modified_base (371)..(371): a, c, t, g, unknown or other
  modified_base (445)..(445): a, c, t, g, unknown or other
  modified_base (501)..(501): a, c, t, g, unknown or other
  modified_base (514)..(514): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtcccgaggcccggggggggtccctggacgactctcctgtgcagcctctgcattcacctttagtaactattaatgagctgggtccnccagccctccgagggtaggggcnggagtgggngcagcataacaagntggacctagaaaatctagtgnggactcgtggtgaacgggccagttccgccaatctacccagaacgacaaacgcccaaagaaccttcgaacgttgnggctagccaacgatcggaaaccggcctagaagaggaccgaacggacaccggtacgngtcgtctttcggnggtcgacggacgacccgccccgtagtacggaacggtacctacggacgggtcgggacgtacgtacgtacg

SEQ ID NO: 398760 - DNA, 731 bp, Homo sapiens
  misc_feature: GZ8MTXP02HMFHV.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaggtgtccagtgtgaggtgcaacgtggtggagtcggtgggggaggtcgttgggtccgacgggcccggggggggttccctggaacgaccttccgtccgtggtgccacgcctctgctaattcctaaccttttaagtaaaccttatttaaactgacgtcgtcgggtccaccagccctcggaaggggtaacgggctaggggagttaggggtcgacccgtagctaaacttaaaccgaaagtagtacggaaccgttaaagaaaaaacttcgtaagttggacggtaacttcgtagggtaggaaaccggggtccgtaatttcccgactactacccgtacgaacgaaacgaaccgaaaccgacccgaaaacgtaacctacgtaaccgtgggtcgcgttacgacctaacgagtacggaccggacgtacgaaggaccgggacaaacgggacaccggtctacggttacgttaccttggtagtaccggacgtaacggacccccgtccccctaaggtacggaaccggtacgtaaccggagggttacgggaaccgacgtttaccgtttaaccgg

SEQ ID NO: 398761 - DNA, 703 bp, Homo sapiens
  misc_feature: GZ8MTXP02GI92O.38.4.A04.1.454.CMB.2.raw
  modified_base (263)..(263): a, c, t, g, unknown or other
  modified_base (303)..(303): a, c, t, g, unknown or other
  modified_base (324)..(324): a, c, t, g, unknown or other
  modified_base (331)..(331): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctccagggaagggctgggagtgggtggccagcattaaccaagatggacgtagaaaaatactatgtggactctgtgagggcgattcgccatctccaganacaacgcaaagaactcactgtggctgcacatcgaacgccngagaggcacgacacggctgtntacttcngtgcgagacgccccagtagacgggtctaacgaggtggacgtcgtaacgacttttacgaccgtacggttgggggcccgtaacggggtaaacccgtcggtaccctacccgttccgtcccgtaccaccggcctcccgaaccccggaacgggtcccctacggttcccgggttcccctttcccccggtcgggaccctacccccgttcccacccgtaaacgacggccctaacccggtccggtacgggggacccaaacggtccggtcccgggccccggttggggcctccgggtacccggttcgggttaccgaaaccggggtaccttaacccgttacccggtacggtacgtaacgtaccggtaaccgttcgggaccgggg

SEQ ID NO: 398762 - DNA, 810 bp, Homo sapiens
  misc_feature: GZ8MTXP02GMAJI.38.4.A04.1.454.CMB.2.raw
  modified_base (267)..(267): a, c, t, g, unknown or other
  modified_base (301)..(301): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttcctgttgctatttagaaggtgtccagtgtgaggtgcaacgtggtggagtcgtgggggaggcgttgggtccgagggcccgggggggtccctggacgactctcctgtgcagcctcngcattcactttagaactattatgagctgggtccncagcctcgagggaaggctggagtgggtggaccagcaattaaaccgaagagtggaaccgtaagtaaaaaatctaagtggtaggtaactcgttagggtacgggaaacggggtacccgtacgtttaccggaccctaacttacccgtacccgaaacggtaaacgaaaacccgaaaacccgaaaccccgtaaaaacggaaaaccccttaccgtaaacccgttaggttaccggggaccttacgggaccctaaacgtaacggttaaccggaaacccgggtaccgttaacggggaaacgggaacgggaacccgggtaaacccggaaccgtaaccgggggtcgtttaacgggggttactttaaccggtttcccggttaggttaccgggtacccgggtaaaacgggacccccggttaacccccccgaacggtttaacccgggggaacgggttaaccccgttaaacggggaacggggttacgggggaacgtacccggtttaaaaccgggtttaaacccgg

SEQ ID NO: 398763 - DNA, 628 bp, Homo sapiens
  misc_feature: GZ8MTXP02FFPQL.38.4.A04.1.454.CMB.2.raw
  modified_base (309)..(309): a, c, t, g, unknown or other
tcagtcgatcacgtcacgaccggtgctcgatttagagtagtgatcaggggaggtctcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtggggggaggcttgggtccgaggccgggggggtccctggagactctctgtgcagcctctgcattccacctttaagtaacttatttaatgagcgtgggtccnccagcctccgaggggagggctgggaggtggggtgccgagctaattaaaccgaagagtacggacgtaagaaaaaatacgttatcggtgtactcgtaggtagggaaacggggcccgtaatttcccgaccgtaatccttaccaggaacgaaccaaaccgacccaaaacggaacctactacgtacgtacggctcggacactagtacggaacggccgtagaggacggacgacgacgacggtcgtgtacgttacttcgtacgtcgtacgacgacccgacccccgagtcggacggtaccgtacgaggtacggacgtcgttaaacgg

SEQ ID NO: 398764 - DNA, 642 bp, Homo sapiens
  misc_feature: GZ8MTXP02H65K0.38.4.A04.1.454.CMB.2.raw
  modified_base (261)..(261): a, c, t, g, unknown or other
  modified_base (274)..(274): a, c, t, g, unknown or other
  modified_base (313)..(313): a, c, t, g, unknown or other
  modified_base (357)..(357): a, c, t, g, unknown or other
  modified_base (366)..(366): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaatgagctgggtccgccagcctccgagggaagggctggagtgggtggccagcattaaccaagatggacgtagaaaaatctatgtgactctgtagaaggccattcgcatctcaganacacgcaagactnactgtgctgcacatgaacgctgagaggcacgacgcggtntgtcgtacttctgtgcgacgccgccccagtggacggtctaacgnggtaggacncgttacgttactttcggacctacggtcggggaccacggggtaacccttggaccctacccgtctccctacgacgtccctaccgaacccgaaaccgggtccccagttcccgggtcccctttccccggaccggtacccctacccccgttccgaccaaacggtcaccctacccggtcgggtcggggaccacgaccggccggccggtcggctacggtccgttacgaccgtaacggacccttaaccgttaccgacgttcgaagtcccgtagtacgggacggg

SEQ ID NO: 398765 - DNA, 709 bp, Homo sapiens
  misc_feature: GZ8MTXP02JBMT3.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcgttgggttttccttgttgcttattttagaaggtgtccagtgtgaggtgcaacgtggtggagtcgtgggggagtcgttggtccgagggcccggggggtccctggacgactctcctgtgcacgcctctgctattcctaacctttagtaacttattaatgagcgtggtcccgccagccctcgaggggagggctggaggtggggtgaccagcaacttaaaccgaagagtaggaacccgtaagaaaaaactcgtaatggtacggacttcgtaggtacgggaaacggggtcctagttccgcctaagtcctacgaggaaacgaccgaaaccggaacccaaaacgtacctacgaaccgttgggcggccttacggacccaagtacgttaacgggaaacccggcccgttagggaacggaagggtacccggaaaccggaccgaacggtccgttaggttacggtttaacctttgttcggtacgggacggaaccggtacccgaccccccgttagtacggggaaccgggtaccgttaaccggaggggtacgggacctacggtaaacgttttaacccgg

SEQ ID NO: 398766 - DNA, 805 bp, Homo sapiens
  misc_feature: GZ8MTXP02FIT93.38.4.A04.1.454.CMB.2.raw
  modified_base (271)..(271): a, c, t, g, unknown or other
  modified_base (316)..(316): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggaggtcttggtccgagggccgggggggtccctggacgactctccgtgtcgcacgcctntgctattcacctttagtaacttattaactgagtcgtcgggtcccncacgccctcggaggggacgggcgtggaggtggggtcgccagcctaaacttaaaccgaggtacgtaggaaccgtaagtaaaaaactcgtaagttcggtacgggtaaccttcgttacgggtaacggaaacgggggtccccgtaagtttcccggaccccttaaacgttacccgttacccgaaaacgggtaaaccgaaaaccccgtaaaacccgggtaaacccccgtaaaaaacggaaaccctttacccgtaaaacccgttggggttacggggtccctttaccggggacccttaaaaccgacggttacccggggaaaaccgggttcccggttaagggaacggaacgggggacccgtaaaccggaccggaccggttaccgttggttacggtttaacctttccgggtagttaccggaccggaaccgacccgtaccccccgaggttacggaacggtaccgtacgaggggttacggacgtaaccgtcgtttaaacgg

SEQ ID NO: 398767 - DNA, 682 bp, Homo sapiens
  misc_feature: GZ8MTXP02F6E96.38.4.A04.1.454.CMB.2.raw
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtgggggaggcttggtccaggccggggggtccctggagactctcctgtgcagcctctgctattcacctttagtaaacttatttaatgagcgtgggtccgccagccctccgaggggaggggctggagtgggtggccagcataaccagatggaccgtagaaaatactagtgtaggactcgtggtacggaaacggggtccgtaatttccggaccctagttacccgtacccgaaaggaacggaaaccgaaaacccggacccgaaaacggaaccctaccgaaccgttacggtcgggaccttacggacctaacgaacgttacgggaaaccgggtcccgttaggaacgggacggggaccggaacggaaccgaccggggaccgttggttacgttaacctttcgtcggttcggacggaacgacccgaccccccgagtcgggaacgggtcgtaaccgaggggtacgggacgtaccgtacggtttaaccg

SEQ ID NO: 398768 - DNA, 706 bp, Homo sapiens
  misc_feature: GZ8MTXP02F50F9.38.4.A04.1.454.CMB.2.raw
  modified_base (289)..(289): a, c, t, g, unknown or other
  modified_base (301)..(301): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttgggtccaggccgggggggtccctggagactctcctgtgcagcctctgcattcacctttagtaactatttaangagctgggtccnccagcctccgagggaggctggagtgggtgccagcaattaaccagatggacctagaaaatactatgtggacttcgtgtaggaaacggggcctaagtttcgaccctattcccgtacccaaacggacgaaaccaaaaccgacccgaaaacgaaccgttaccgaaaccgttgggtacgggcttacggacccaaaccgtagtaaccggaaaccggtcccgttaagggaacggagggacccggaaccggaacctccggggtaccgtttggtacggtttaacccgtttccggttgggtaccggtaccggtaaacggaccccggacccccccctaaggttacgggaaccggggttaccccgtaaacgggtaccggggttagggggaaccgtaccgttaaccggtttaacccgg

SEQ ID NO: 398769 - DNA, 551 bp, Homo sapiens
  misc_feature: GZ8MTXP02I52QF.38.4.A04.1.454.CMB.2.raw
  modified_base (258)..(258): a, c, t, g, unknown or other
  modified_base (300)..(300): a, c, t, g, unknown or other
  modified_base (476)..(476): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccaggccggggggtcctgagactctcctgtgcagcctntgctattccacctttagtaactatttaatgagtcgtggtccnccagcctcgaggggagggctggagtgggtgccagctataaccagatggaccgtagaaaaatctatgtgactctgtggaaggcctattcgaccatctacagagaacaacgccaaagactcacgtgtagctgacacagtacgaaccggcctaggacgacgggacgacgtacgacggtntggtgtacttcgtgtcggacgagacccgcccccagtaggaacggtctacgagggtaggacgtacgttacggtacg

SEQ ID NO: 398770 - DNA, 674 bp, Homo sapiens
  misc_feature: GZ8MTXP02H1UBG.38.4.A04.1.454.CMB.2.raw
  modified_base (221)..(221): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactattttaatgagctgggtccgccagcctccgaggggaagggctggagtgggtggccagcaattaaccaagatggacgtanaaaaaatctatgtggactctgtggaaggccattcgccatctcagagacaacgcaagaactcactgtgctgcacatgaacgcctaggaggaggcgacgacgacggctgtgtacttcgtgtgacgagaccgcccccagtggacgggctaacgagggtcggggactccgtaacgttacttttcgacgttacggtcgggggacctaacggggaccctggtcccacccgtcctcccgtctacgcccctacccgaaccgaacgggcccctacgtcccggttaccccttcccccgacgtccctaccccctccgtaccgaacgaccgtaccctacccggttcggggaccggggaccaaccggccgggcccggcccggttcgggccgtccggccggttacggtaccgaaacggttaccttaaccgtccgtaaacggtcgtacgtaccggtacgtacggcggg

SEQ ID NO: 398771 - DNA, 634 bp, Homo sapiens
  misc_feature: GZ8MTXP02IT0ZG.38.4.A04.1.454.CMB.2.raw
  modified_base (258)..(258): a, c, t, g, unknown or other
  modified_base (289)..(289): a, c, t, g, unknown or other
  modified_base (302)..(302): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaggtgtccagtgtgaggtgcaactggtggagtcgtgggggaggcttgggtccgaggcccgggggggtccctggagactctcctgtgcngcctctgcattcaccttagtaactatttaangagcgtgggtccnccagcctccggaggggaaggggctgggaggtggggtcggccagacaagttaaaccaagagtaggaaccgtaagaaaaatctaagtggtacggactcgtgtaggaacgggcctagttccgacctactccgtaccaaggacgaaccgaaccgaccaaagtacctaccaacgtgtcgggactacggaccacacgttacggaaaccggcgtaggaggacggacgaaccgacgaccgggcttgtcgttacttcgtggtcgaccggacgacccgaacccccgtggtacggaacggtccgtaacgacgggttcggggaacgtccgttaacggtttaccg

SEQ ID NO: 398772 - DNA, 710 bp, Homo sapiens
  misc_feature: GZ8MTXP02GCDBT.38.4.A04.1.454.CMB.2.raw
  modified_base (300)..(300): a, c, t, g, unknown or other
  modified_base (304)..(304): a, c, t, g, unknown or other
  modified_base (322)..(322): a, c, t, g, unknown or other
  modified_base (379)..(379): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgcagcctccgagggaaggggctggagtgggtggccagcattaaaccaagatggacgtagaaaaatactatgtggactctgtgaagggccattcgcatctcagagacaacgccaagactcactgtgctgcacatagacggcngagnggcacgacacggtctgtntacttctagtcgacgagaccggtcccccaagtggaacgggctaacgaggtcgggganccgttaacgacgttttaggaaacctttcgggtacgggggacccaaacggggtaaacccgtcgggtaccgacccgttcctcccgtaccacggtaccccctacccgaaacccggaaccggccccgaacgtttccccgggttccccttaccccccggttcggacccctacccccttaccctaccgaaaccgaaccggccctaccccgttcgggccgggggacaccgtacggcccgggccccggtgggggtcctcggtcccgtacgggttaacgtaacgggaacccgtttaaccgtaccgtaaccggtgtaccgttaacggacgtacggaccggg

SEQ ID NO: 398773 - DNA, 545 bp, Homo sapiens
  misc_feature: GZ8MTXP02IZOKR.38.4.A04.1.454.CMB.2.raw
  modified_base (300)..(300): a, c, t, g, unknown or other
  modified_base (371)..(371): a, c, t, g, unknown or other
  modified_base (416)..(416): a, c, t, g, unknown or other
  modified_base (424)..(424): a, c, t, g, unknown or other
  modified_base (429)..(429): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcttggtccagggccggggggtcctgagactctctgtgcagcctctgcattcacctttagtaaacttatttaatgagtcgtgggtccnccagcctcgagggagggctggagtggtggccagcataaccagagtgacgtagaaaatactagtgtggactntggtgaacggggcctattcgcatctcagacgacacgacaagactnacgtgtgntgcanatacgacgctgagacggcgacgacgacggtctgtgttacttctggtcgacgacggccgacccccagttacggaacgggtactacggtaacggcggggacgtacgttaccggttacg

SEQ ID NO: 398774 - DNA, 640 bp, Homo sapiens
  misc_feature: GZ8MTXP02G48Y6.38.4.A04.1.454.CMB.2.raw
  modified_base (149)..(149): a, c, t, g, unknown or other
  modified_base (161)..(161): a, c, t, g, unknown or other
  modified_base (384)..(384): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcaccttttagtaactatttaangagctgggtccncagcctccgagggaaggggctggagtgggtggccagcattaaccaagatggacgtagaaaaaatctatgtggactctgtagaagggccattcgccatctcagagacaacgacaagaactcactgtgctgcacatgaacgcctagagaggcgaacacgacggactcgtggtacctttcgtagtgacgagaccgtcccccaagtgacggggactacgaggtgganctacgatttgactacgtggggcccagggaaccctggaccaccgtctcgtaccacgaccctccgaaccgaacgggccctaacgtcgggtccccttcccccgtcggaccctaacccttccccgtaaccaacggaacccgacccgtacccgtcggtacgggaccgaacgacgggtcccggcccggtcggtacgtccggtacgtacggaccgaacggtacccttaacgtacccgacgtacgtacgtccgacgtcggacgg

SEQ ID NO: 398775 - DNA, 742 bp, Homo sapiens
  misc_feature: GZ8MTXP02GGB59.38.4.A04.1.454.CMB.2.raw
  modified_base (259)..(259): a, c, t, g, unknown or other
  modified_base (264)..(264): a, c, t, g, unknown or other
  modified_base (296)..(296): a, c, t, g, unknown or other
  modified_base (312)..(312): a, c, t, g, unknown or other
tcagtcgatcacgtcacgaccggtgctcgatttagagtagtgatcagggggtctcagagaggagccttagccctggactccaaggcctttccacttggtgatcagcactgagcacagaggactcaccatggaattgggctgagcttgggttttccttgttgcttattttagaaggtgtccagtgtgaggtgcaacgtggtggagtcgtgggggagtcttggtccgagggcccggggggtcctggagactctcctgtgcngcctntgctattcaccttttagtaaacttatttaagngacgtcgtcggtcccnccgacgcccgtacggaaggggtacggtcgtagggaggtggggtcgaccgagactaaacttaaaccgaagtagtacggaaaccgtaaagtaaaaacttacgttagtacggtacggtaacttcggtacgggtaacggggaaaccggggtcccgttaacgttacccggacccttaacgtacccgtaccgaaaggaacgaaacccgaaacccgtaaccaaaacggtaaccctaccgtaacggtggtaccggtactacggacccaaacgtacggtaccggaaaccgggtaccgtagggaacggacgggaccgtaacgacccggtacggtcgttaggttacgttacgtttcggaggtccggacggtaccgccccgtaccccgaggtacggaaccggtacgtacggacgggtacggaccgtaccgttaacggttacg

SEQ ID NO: 398776 - DNA, 577 bp, Homo sapiens
  misc_feature: GZ8MTXP02JR4PE.38.4.A04.1.454.CMB.2.raw
  modified_base (377)..(377): a, c, t, g, unknown or other
  modified_base (493)..(493): a, c, t, g, unknown or other
  modified_base (574)..(574): a, c, t, g, unknown or other
tcagtcgatcacgtcacgaccggtgctcgatttagagtagtgatcagggggaagaccgatgggcccttgggggaggcttggtccagccggggggtccctgagactctcctgtgcagcctctgcattcacctttagtaactatttaatgagctgggtccgccagcctccagggaaggggctggagtgggtggccagcattaaccaagatggacgtagaaaaatactatgtggactctgtggaagggccgattcgccatcctccagagacaacgcaaagactcactgtggctgcacagtagaaccggctggaagacggcgacgtacacggtctgtgttacttctggtcgcgagaccggtcccccagtggacggctacgnggtgggatccgtacgtctttagaccgtgtcggggacgacgggaaccctggtccaccgtcctctccgacgccctaccgaaccgacgggcccctagtcccgtcccttccccgtgcccnccctcccaccacgacgccacctcggcggggcacgcgccgccgtggctgactcggacagctaacgtcacgtgactcgtacgngcg

SEQ ID NO: 398777 - DNA, 723 bp, Homo sapiens
  misc_feature: GZ8MTXP02ITZ3O.38.4.A04.1.454.CMB.2.raw
  modified_base (282)..(282): a, c, t, g, unknown or other
tcagtcgatcacgtcacgaccggtgctcgatttagagtagtgatcagggggaagaccgatgggcccttgggggaggcttggtccagccgggggggtccctgagactctcctgtgcagcctctgcattcacctttagtaactatttaatgagctgggtccgccagcctcgagggagggctggagtgggtggccagcattaaccaagatggacgtagaaaaaatctatgtggactctggtgaagggccgtatcgccatctcagagacaacgcaagactcactgnggctgcacatgaaccggcctgagaggcgacgacgacggctggtcgtacttcgtgtgcgagaccgcccccagtggacgggtctacgagggtggggactccgtaacgacttttggaacttacggtcgggggaccaacggggaaccccttgggaccctacccggtcctcctccacgtcccctacccgaacccgaaccggggtacccctacgttacccgggtttcccttccccccgttcgggaccccctacccccctaccccgtacccgtaaaaccggaccggtaccctaccccggtaaccggtccgggggaccacccggaccgggccccgggtccccgttcgggggcctccgggtaccccggttgggtaacccgtaaaggggtaccccttaaaccggttccccgtaacggtacgtaacgtacccggttacgacggtaacggggg

SEQ ID NO: 398778 - DNA, 794 bp, Homo sapiens
  misc_feature: GZ8MTXP02JWLX3.38.4.A04.1.454.CMB.2.raw
  modified_base (238)..(238): a, c, t, g, unknown or other
  modified_base (258)..(258): a, c, t, g, unknown or other
  modified_base (297)..(297): a, c, t, g, unknown or other
tcagtcgatcacgtcacgaccggtgctcgatttagagtagtgatcagggggaagaccgatgggcccttgggggaggcttggtccagccgggggggtcccgtgagactctcctgtgcagcctctgcattcacctttagtaactatttaatgagctgggtccgccagcctccagggaagggctggagtgggtggccagcattaaccaagatggacgtagaaaaatactatgtggatctgngaaggccgattccgccatcnccagacgacaacgcccaaagtaacctcacgtgtggtccngacagagtacggaccgcgtaggacggacggaccgaccgacgacggtcgtagtacgttcttgtgtcgacgaccgaccccgtaccccgtaccggagggacgggtactaccggtaggggtacggggtactccgtaaaccggttcgtttacggaaccgtttccggggacgggggtaccccggtaaacgggtacccgtccggtacccgtacccgttccgttacccgtccgacccgtaccccgtacccgaacccggtaacccgggtccccgttaccggttcccccggttcccccgttacccccggtcccggtaccccctacccccgttaccccgtaaccgtaaccgacccgtacccgacccggttccgggtaccggggccaacccgggtcccggccccgggtcccggtcgggtccccgtccggtcccggttaaccggtacccggtaacgtacccgttaacccgttacccgtacgtaccgtaccgtaccggtacgtcgggcggg

SEQ ID NO: 398779 - DNA, 690 bp, Homo sapiens
  misc_feature: GZ8MTXP02FKLQD.38.4.A04.1.454.CMB.2.raw
  modified_base (258)..(258): a, c, t, g, unknown or other
  modified_base (346)..(346): a, c, t, g, unknown or other
tcagtcgatcacgtcacgaccggtgctcgatttagagtagtgatcagggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcttggtccgaggccggggggggtccctggagactctcctgngcagcctctgcattctacctttagtaacttaatttaatgagtcgtgggtccgccacgcctccgaggggaaggggctggaggtcggggnggccgagcaaataaaccaaagagtcggaagtagaaaaaatactatgtaggactcgtggtaggaacgggccaagtttccgacctatctcccgaagtaacgacgaaaccgaccaaaagaaaccttacaacgtgggtacggtctacggcaactaagacggaaaaccgggccgttggaaggacgggaccggaaccggaacgaaaccgggggtccttaggttcgtttaaaccgtttcgttgggttacggaccgggtaacggaaccccggtacccccccgtaacgtcggggaaaccggggtacctaaaaccggaaggggttaggggaacggtaccgtttaaaacccgggg

SEQ ID NO: 398780 - DNA, 428 bp, Homo sapiens
  misc_feature: GZ8MTXP01BEDDA.15.12.B01.1.454.CMB.2.raw
  modified_base (336)..(336): a, c, t, g, unknown or other
  modified_base (424)..(428): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttactatgatactcgtggttatccccagcgagccttttgactagttcgggggcccggagccctgggtccaccgtctcctcagcttccaccaagggcccatcggtcttccccctggcgcccctgctccaggngcacctctgggggcacagcggccctgggctgcccctggtcaaggctacttccgctcgtagactgagcgggctgggcaaggcgcatagnnnnn

SEQ ID NO: 398781 - DNA, 419 bp, Homo sapiens
  misc_feature: GZ8MTXP01BSZOC.15.12.B01.1.454.CMB.2.raw
  modified_base (318)..(318): a, c, t, g, unknown or other
  modified_base (331)..(331): a, c, t, g, unknown or other
  modified_base (412)..(412): a, c, t, g, unknown or other
  modified_base (415)..(419): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggacctatggattcggccacgtattactgtgcacggacctctgactaccttttacatgatactcgtggttatccccagcgagtcctttgactagttgggggcccggagccctggtccaccgtctcctcagcttccaccaagggcccatcggtctccccctggcnccctgctcaggancactcgtgggggcacagcggccctgggctcgccctggtcaaggctactccgctcgtagactgagcgggctggcaggcgcanagnnnnn

SEQ ID NO: 398782 - DNA, 426 bp, Homo sapiens
  misc_feature: GZ8MTXP01AWZN4.15.12.B01.1.454.CMB.2.raw
  modified_base (261)..(261): a, c, t, g, unknown or other
  modified_base (422)..(426): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttactatgatactcgtggttatccccagcgagcctttgactattgggggcccgganccctggtcaccgtctcctcagcttccaccaagggcccatcggtcttccccctggccgcccctgctccaggagcacctctgggggcacagcggccctgggctgcccctggtcaaggcctacttcccgctcgtagactgagcgggctgggcaaggcgcatagnnnnn

SEQ ID NO: 398783 - DNA, 425 bp, Homo sapiens
  misc_feature: GZ8MTXP01DN3CK.15.12.B01.1.454.CMB.2.raw
  modified_base (423)..(425): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttactatgatactcgtggttatccccagcgagcctttgactattggggccccgggagccctgggtcaccgtctcctcagcttccaccaagggcccatcggtcttccccctggcgccctgctccaggagcacctctgggggcacagcggcctggggctgcccctggtcaaggactacttccgctaacgtagactgagcgggctgggcaaggcgcatagnnn

SEQ ID NO: 398784 - DNA, 625 bp, Homo sapiens
  misc_feature: GZ8MTXP01DOFH8.15.12.B01.1.454.CMB.2.raw
tcagtctacgtagccacgaccggtgctcgatttagtagtgtagatttgggtttaggggatcaggactcctcagttcaccttctcacaatgaggctccctgctcagctcctggggctgctaatgctctgggtctctggatccagtggggatattgtgatgactcagtctccactcctccctgccccgtcacccctggagacgccggcctccatctcctgcaggtctagtcagacgcctaccagcatactgatggataactaacttagttggattcggtactgacaagaacgccgagggacacgtccaccaccaaccttccgtagtattctttagttttcgggtactaacggtccggccgttccggggtccccctggtactgggttcaggtcggctaaggtgtatcgagtactagtagttactttacacgttaagaaactcgaagagtaaggaggtgggagacgttagggaacgggtttaggtttaggggtttaaattctggacagtacgacgtaacgtactaaacccaacccgtactacgtacccgtcgggccgaacgggacgacgttacgtaggaacgttaacgttaaacgttacgttggcgcgtcgacttactaacttcgtccg

SEQ ID NO: 398785 - DNA, 478 bp, Homo sapiens
  misc_feature: GZ8MTXP01DK4J0.15.12.B01.1.454.CMB.2.raw
  modified_base (319)..(319): a, c, t, g, unknown or other
  modified_base (322)..(322): a, c, t, g, unknown or other
  modified_base (329)..(329): a, c, t, g, unknown or other
  modified_base (453)..(478): a, c, t, g, unknown or other
tcagtctacgtagccacgaccggtgctcgatttagtagtgtagattccgcgggggactgggatgatgataagttctacaacacatctctgaagaccaggctcagtatctccaaggactcctccggaaaccaagtggtccttagaatgaccaacatggaccctatggattcggccacgtattactgtgcacggacctctgactaccttttactatgatactcgtggttatccccagcgagtcctttgactagttggggcccggagccctggtccaccgtctcctcagcttccaccaaggcccatcggtcctcccctggcnccngctcagnccacgtcgtgggggcacgacgccggccctggggctcggtcccctgggtacaaggtacccttacgttcccgactaacggtaagacgtcgggaggccggggctcggggacgaagggcgacagtagnnnnnnnnnnnnnnnnnnnnnnnnnn

SEQ ID NO: 398786 - DNA, 419 bp, Homo sapiens
  misc_feature: GZ8MTXP02JY0SV.15.12.B01.1.454.CMB.2.raw
  modified_base (416)..(419): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttacatgatactcgtggttatccccagcgagcctttgactattggggcccggagccctggtcaccgtctcctcagcttccaccaagggcccatcggtcttccccctggcgccctgctccaggagcacctctggggcacagcggccctgggctgcccctggtcaaggactacttccgctacgtagactgagcgggctggcaaggcgcatagnnnn

SEQ ID NO: 398787 - DNA, 420 bp, Homo sapiens
  misc_feature: GZ8MTXP02JEOL9.15.12.B01.1.454.CMB.2.raw
  modified_base (418)..(420): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttactatgatactcgtggttatccccagcgagcctttgactattggggcccggagccctggtcaccgtctcctcagcttccaccaagggcccatcggtcttccccctggcgcccctgctccaggagcacctctggggcacagcggccctgggctgcccctggtcaaggactacttccgctcgtagactgagcgggctgggcaaggcgcatagnnn

SEQ ID NO: 398788 - DNA, 440 bp, Homo sapiens
  misc_feature: GZ8MTXP02HFW3B.15.12.B01.1.454.CMB.2.raw
  modified_base (369)..(369): a, c, t, g, unknown or other
  modified_base (436)..(440): a, c, t, g, unknown or other
tcagtctacgtagccacgaccggtgctcgatttagtagtgtagattccgcgggactgggatgatgataagttctacaacacatatctgaagaccaggctcagtatctccaaggactcctccggaaaccaagtggtccttagaatgaccaacatggaccctatggattcggccacgtattactgtgcacggacctctgacaccttttactatgatactcgtggttatcccagcgagcctttgactattgggccggacggcctcgtcgaccgtctcctcagctcctaccaacggccgactcggtcgttccccctccgcggccctcgctccacggagcacctcctggggcggacagcggccctcgggcgtcncccgtcggtcgaacgacgtacttccgctccgtagactgagcggggcgtggcgaaagcgcctataggnnnnn

SEQ ID NO: 398789 - DNA, 410 bp, Homo sapiens
  misc_feature: GZ8MTXP02GDOI6.15.12.B01.1.454.CMB.2.raw
  modified_base (314)..(314): a, c, t, g, unknown or other
  modified_base (324)..(324): a, c, t, g, unknown or other
  modified_base (331)..(331): a, c, t, g, unknown or other
  modified_base (339)..(339): a, c, t, g, unknown or other
  modified_base (406)..(410): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttactatgatactcgtggttatccccagcgagtcctttgacttagttgggggcccggagccctggtccaccgtctcctcagctccaccaggcccatcgtctcccctgcncctgctcagncactcgnggggcacngcgcctggctgccctggtcaaggactactccgctacgtagactgacgcgggctggcaagcgcatagnnnnn

SEQ ID NO: 398790 - DNA, 449 bp, Homo sapiens
  misc_feature: GZ8MTXP02I64HD.15.12.B01.1.454.CMB.2.raw
  modified_base (439)..(449): a, c, t, g, unknown or other
tcagtctacgtagccacgaccggtgctcgatttagtagtgtagattccgcggggactgggatgatgataagttctacaacacatctctgaagaccaggctcagtatctccaaggactcctaccggaaaccaagtggtccttagaatgaccaacatggaccctatggattcggccacgtattactgtgcacggacctctgactaccttttactatgatactcgtggttactccccagcgagtcctttgacttagttgggggccccgggagcccgtggtccaccgtctcctcagcttccaccaagggcccagtccggtccttcccccgtggcccgccctgcctccaggacgccacctcgtggggcacgagccggcccgtggctgccccgtgcaaggctactccgctacggctggacgcgggctggcgaacgggcacatagnnnnnnnnnnn

SEQ ID NO: 398791 - DNA, 421 bp, Homo sapiens
  misc_feature: GZ8MTXP02GPITF.15.12.B01.1.454.CMB.2.raw
  modified_base (416)..(421): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttactatgatactcgtggttatccccagcgagcctttgactagttggggcccggagccctggtcaccgtctcctcagcttccaccaagggcccatcggtctccccctgcgccctgctccaggagcacctcgtggggcacgagccggccctggggctgccctggtcaaggctactccgctcgagactgagcgggctgggcaaggcgcatagnnnnnn

SEQ ID NO: 398792 - DNA, 430 bp, Homo sapiens
  misc_feature: GZ8MTXP02F6NBF.15.12.B01.1.454.CMB.2.raw
  modified_base (418)..(418): a, c, t, g, unknown or other
  modified_base (424)..(430): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtatactgtgcacggacctctgacaccttttactatgatactcgtggttatccccagcgagcctttgacttattgggggcccggagccctggtcaccgtctcctcagcttccaccaagggcccatcggtcttccccctggcgcccctgctccaggagcacctctgggggccacaggccggccctggggctgcccctggtcaaggactacttccgctacgtagactgagcgggctggcaaggcncatagnnnnnnn

SEQ ID NO: 398793 - DNA, 421 bp, Homo sapiens
  misc_feature: GZ8MTXP02GTB1N.15.12.B01.1.454.CMB.2.raw
  modified_base (309)..(309): a, c, t, g, unknown or other
  modified_base (312)..(312): a, c, t, g, unknown or other
  modified_base (324)..(324): a, c, t, g, unknown or other
  modified_base (339)..(339): a, c, t, g, unknown or other
  modified_base (375)..(375): a, c, t, g, unknown or other
  modified_base (382)..(382): a, c, t, g, unknown or other
  modified_base (405)..(405): a, c, t, g, unknown or other
  modified_base (412)..(421): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgactaccttttacatgatactcgtggttactccccagcgagtcctttgacttagttggggcccggagcccgtggtcaccgtctcctcagctccacaggccatcgtctccccngcncctgctcagacncactcgtggggcacngcgcctgggctgcccctggtcaaggactacttccgntacgtanactgagcgggctggacgaaggcncgatagnnnnnnnnnn

SEQ ID NO: 398794 - DNA, 411 bp, Homo sapiens
  misc_feature: GZ8MTXP02FQZKO.15.12.B01.1.454.CMB.2.raw
  modified_base (311)..(311): a, c, t, g, unknown or other
  modified_base (314)..(314): a, c, t, g, unknown or other
  modified_base (318)..(318): a, c, t, g, unknown or other
  modified_base (324)..(324): a, c, t, g, unknown or other
  modified_base (330)..(330): a, c, t, g, unknown or other
  modified_base (338)..(338): a, c, t, g, unknown or other
  modified_base (345)..(345): a, c, t, g, unknown or other
  modified_base (373)..(373): a, c, t, g, unknown or other
  modified_base (404)..(411): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacaccttttacatgatactcgtggttactccccagcgagcctttgactagttgggggccccggagccctggtccaccgtctcctcagcttccaccaggcccatcgtctccccngcncctnctcagncactcnggggcacngcgcccnggctgccctgtcaggctactccgctcgngactgagcgggctgggcaaggcgacagtagnnnnnnnn

SEQ ID NO: 398795 - DNA, 485 bp, Homo sapiens
  misc_feature: GZ8MTXP02HODXY.15.12.B01.1.454.CMB.2.raw
  modified_base (360)..(360): a, c, t, g, unknown or other
  modified_base (475)..(485): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgactaccttttactatgatactcgtggttactcccagcgagtcctttgacttaggtcgggggcccggagtcccgtggtccaccgtcctcctcacgccttacccaaccgaacgggccccagtccggtcccttcccccgtggcccgtccctcgcctccgaggacnccaccgtcggcggggcacgagccggcccgtgggcctgccccgtggacaaggtaccttacgttcccgcttaccgtagacgtggacggccgggcgtaggccgaaaggccgacagagnnnnnnnnnnn

SEQ ID NO: 398796 - DNA, 455 bp, Homo sapiens
  misc_feature: GZ8MTXP02HK19N.15.12.B01.1.454.CMB.2.raw
  modified_base (317)..(317): a, c, t, g, unknown or other
  modified_base (356)..(356): a, c, t, g, unknown or other
  modified_base (443)..(455): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgactaccttttactatgatactcgttggttactccccagcgagtcctttgactagttcggggcccggagccctggtcaccgtctcctcagctccaccaagggcccatcggtcctcccccnggccgccctgcctccaggacgcacctcgtggggccacgngccggcccgtggggctgccccgtggtacaacggaccttaccgttccgacttacgtagactgacgcggggctgggcaaggcgcagtgnnnnnnnnnnnnn

SEQ ID NO: 398797 - DNA, 521 bp, Homo sapiens
  misc_feature: GZ8MTXP02HMERH.15.12.B01.1.454.CMB.2.raw
  modified_base (511)..(521): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgactaccttttacatgatactcgtggttactccccagcgagtcctttgactagttcgggggccccggagccccgtggtccacccgtctccctcagccttccaccgaacgggccccagtccggtcccttccccccgtggcccgtcccctgcctccgaggacgcccaccgtcggtcgggggccacgacggccggcccgtggggcctcggaccccgtcgggtaccaaacgggtaccttaccgttccccggacttaccgggtacgtaccgtgggacggccgggggtacgtcggggacgaaacgggccgtacaagtagnnnnnnnnnnn

SEQ ID NO: 398798 - DNA, 538 bp, Homo sapiens
  misc_feature: GZ8MTXP02FZKVK.15.12.B01.1.454.CMB.2.raw
  modified_base (518)..(538): a, c, t, g, unknown or other
tcagtctacgtagccacgaccggtgctcgatttagtagtgtagattccgcggggactgggatgatgataagttctacaacacatctctgaagaccaggctcagtatctccaaggactcctccggaaaccaagtggtccttagaatgaccaacatggaccctatggattcggccacgtattactgtgcacggacctctgacctaccttttactatgatactcgttggttactccccagcgagtcctttagacttaggttcgggggcccggacgtcccgtggtccaccgttctccctcacgtccttacccaaccgaaacgggcccctacgtccggttccccttcccccgtcggccccgcccctcggtcctacccgaggacgacccctaccgtcggcggggacccaacgccggggcccggcccggtggtccgtcggccccgtcggtacgaacggtaccttaccgtccgacgtacggtagtacgtggaccggcggcgggtacgacgaacggccgagagtagnnnnnnnnnnnnnnnnnnnnn

SEQ ID NO: 398799 - DNA, 599 bp, Homo sapiens
  misc_feature: GZ8MTXP01CPQPD.51.52.E08.1.454.CMB.2.raw
  modified_base (283)..(283): a, c, t, g, unknown or other
tcagcgatcgtatacacgaccggtgctcgatttagtcgagctctcagagagaaagggcacgaccggtgctcgatttagtcgagctctcagagaggaaaggggtaggctcaggaggcagagctctgattgtctcaccatggcctggatccctctcctgcctccccctctcattctctgcacagtctctgtgcctctatgagctgacacagccatactcagtgtcagtgtctcggacagacagccaggatcactgctcaggagatgtaactaagggaaaaaaatntgcttcgttggttacccagcaggaaaggccggaccacgaccccccctgtcttgatgtaaatttaataagactacgtgacgccggccctacgagggtactcccgtagacgcgtattccgtccggcctccgaacggctacgaacgggtacctacggacgtacctaccgttgaacccctagtccgaacgggccggggacccctagggttcgaaccgactgggaacgggtccttagggtaaccttatttaaaccgtggttttaacccttgttcggtccggacttaacgaacctaaacgttaacgtttccgaagggttaag

SEQ ID NO: 398800 - DNA, 661 bp, Homo sapiens
  misc_feature: GZ8MTXP01CDNLG.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctcccccctctcattctctgcacagtctctgtggcctcctatgagctgacacagccatactcagtgtcagtcgtcgtccggacagacagccaggactcacctgctcgaggagatagtaacgtaaggaaaaaatgtcgcgttcggttacggttacccgaggacgaaggaacggccgggacccacggtcccccccgttgttcgttagtatagtaaatttaaagtaacggacctaacgtaggacggcccgggtaccctacggacggggtacctcccgtggaacgtccggtaacttcccgtcccggtacctccgacgtcgtaccgaacgggtacctaccgtacgggtaccctaaccgttcgaaccgtatccggacgggccgggtacccgtagggttaccgacgtagtcggaacggtcttacggtactttaagtttaccgttagttaccgttcggttacgggtcgtccgtaaggtaacctaaacgttagttaaccggttgggtaacgg

SEQ ID NO: 398801 - DNA, 680 bp, Homo sapiens
  misc_feature: GZ8MTXP01B2Z3O.51.52.E08.1.454.CMB.2.raw
  modified_base (265)..(265): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtggcctctatgagctgacacagccatactcagtgtcagtcgtctccgggacagacagccaggatcactgctcagganatagtaacgtaagggaaaaaaatgtagcttacggtttggttacccagaccgaggaaacgggccgggaccaacggccccccccttggtcttagattaggtaaatttaataaacgactaacgttaggaacggcccgggtaccccgttacggaacggggtactaccccgttaggacggtaccgtaacgtttccgacccggggtccttacccgaacgtccgttacgaaacggggtacctacgtacggggtacctaccgttacggaacccctagtccgaacgggtcccggggaccccgtaaggttcggaaccgttagtgggaacggtccgttagggtaaccctttagtttaaacccgttggtttaaccttcgttacggttcggccttaagaacgtaaccttaagttccgttaagggtaag

SEQ ID NO: 398802 - DNA, 543 bp, Homo sapiens
  misc_feature: GZ8MTXP01C6CNG.51.52.E08.1.454.CMB.2.raw
  modified_base (262)..(262): a, c, t, g, unknown or other
  modified_base (283)..(283): a, c, t, g, unknown or other
tcagcgatcgtatacacgaccggtgctcgatttagtcgagctctcagagagaaagggcacgaccggtgctcgatttagtcgagctctcagagagaaggggtaggctcaggaggcagagctctgattgtctcaccatggcctggatccctctcctgcctccccctcctcattctctgcacagtctctgtgcctctatgagctgacacagccatactcagtgtcagtgtctccgggacagacagccaggatcactgctcagganatgtactagggaaaaaaaatntgactcgttggttccagcagaagcggcaggcccccctgtctgatgaatttataagacactgagccggccctcgaggggactcccgtgacgcggatttccgccggctcccagtcacaggactacaggtccacttgacccatccgaggcgggcccaggttagaccggattggaacgggtcttggtaccttatttaccgtggtttaaccttccgttggaaccgggccttaagaaccctaaacgttaatttccgaagggttaag

SEQ ID NO: 398803 - DNA, 617 bp, Homo sapiens
  misc_feature: GZ8MTXP01CE5SS.51.52.E08.1.454.CMB.2.raw
  modified_base (358)..(358): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctcccccctctcattctctgcacagtctctgtggcctcctatgagctgacacagccatactcagtgtcagtgtctccgggacagacagccaggatcacctgctcaggagatagtaacgtaagggaaaaaatgtagcttcggttggttccagcgaggaacggcgggccgacggtccccccctgtcttgatagtaaatttaanaagacacgtgacgccggccctcgacgggctcccgtgacgcgtacgttccgtccgtcctaccgacgtcctacgaagggtacctaacgacggtctaacctttcgaacccaagtcccgaacgggcccggggaccccgtagggttcgaaccggtagtcgggaacggtcgttacggtaactttaacgtttaccgttcgttacccgttcgttacgggtccgtcgttaacgaacctaaccgttaagtttccggttaagggttaacg

SEQ ID NO: 398804 - DNA, 621 bp, Homo sapiens
  misc_feature: GZ8MTXP01AQTLR.51.52.E08.1.454.CMB.2.raw
  modified_base (267)..(267): a, c, t, g, unknown or other
  modified_base (287)..(287): a, c, t, g, unknown or other
  modified_base (343)..(343): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctccccctcctcattctctgcacagtctctgtggcctcctatgagctgacacagccatactcagtgtcagtgtcgtccgggacagacagccaggatcacctgctcagganatgtacgtaaggaaaaaatntgctcgttgtccagcgagaaggcggccacggcccccctgtctgatgtaaatttaanaagacacgtgacgccggccctacgagggtactcccgtaggacgcggtattccgtcccggtctcccgacgccttacgaacgggtaccttaccgacgggttcctaacccgtttcgaaccctagtccgaacgggcccgggggtacccctaggggttcgaaccggagttggaacgggtccttaggtaacctttagtttaccgttaggtttacccgttcgttccgggaacggtaccttaacgggaaacctaaccgttaagtttcccggttaagggggttaacg

SEQ ID NO: 398805 - DNA, 712 bp, Homo sapiens
  misc_feature: GZ8MTXP01EZGT7.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctcccccctcctaattctctgcacagtctctgtggcctcctatgagctgacacagccatactcagtgtcagtgtctccgggacagacagccaggactcacctgctacgaggagatagtaacgtaaagggtaaaaaaatgtagtcgttcggtttacggttaccaggacgaagggaacgggcccgggacccgaccgggtccccccttggttccgttaggtaattaggtaattttaaaaacgtaaaacggtaacctaacgtcgggaaaccgggtccccgggtacccctacgggaacgggtacccttccccgtaggaacgtaccgtacgtttcccgcccgggtacctaccgacgtccgtaccgacgggtaacctacgtacgtacctaccgttacggaacctacgtaccggaccgggtcccggggacccgtagggtacgaaccgtagtcgggaacggtcgtacgttactttaacgtttacgttacgttaaccttcgttcggttaccggtaacgtacgtaaacctaacgtacgttacggtaagggttaacgttaacgggg

SEQ ID NO: 398806 - DNA, 447 bp, Homo sapiens
  misc_feature: GZ8MTXP01B55M3.51.52.E08.1.454.CMB.2.raw
  modified_base (222)..(222): a, c, t, g, unknown or other
  modified_base (293)..(293): a, c, t, g, unknown or other
  modified_base (418)..(418): a, c, t, g, unknown or other
  modified_base (422)..(422): a, c, t, g, unknown or other
  modified_base (424)..(435): a, c, t, g, unknown or other
  modified_base (437)..(447): a, c, t, g, unknown or other
tcagcgatcgtatacacgaccggtgctcgatttagtcgagctctcagagagaaagggcacgaccggtgctcgatttagtcgagctctcagagaggaaagggggtaggctcaggaggcagagctctgattgtctcaccatggcctggactcccctctcctgcctcccccctctcattctctgcacagtctctgtcgcctctatgagctagacacagccatacncagtgtcagtgtcgtcggacagacagcaggatcactgctcgaggagtatagtaacgtaagggaaaaaaatntagcttcggttaggttacccaggacgaggaaacgggccgggaccgaccggtaccccccctgtcgttagatagtaaattttaaagaacgacgtacgtggaacggcgggacgtggaccgaaggccanaagngnnnnnnnnnnnngnnnnnnnnnnn

SEQ ID NO: 398807 - DNA, 517 bp, Homo sapiens
  misc_feature: GZ8MTXP01ATTU5.51.52.E08.1.454.CMB.2.raw
  modified_base (397)..(397): a, c, t, g, unknown or other
  modified_base (433)..(433): a, c, t, g, unknown or other
  modified_base (443)..(443): a, c, t, g, unknown or other
  modified_base (446)..(447): a, c, t, g, unknown or other
  modified_base (450)..(450): a, c, t, g, unknown or other
  modified_base (458)..(458): a, c, t, g, unknown or other
  modified_base (465)..(465): a, c, t, g, unknown or other
  modified_base (467)..(467): a, c, t, g, unknown or other
  modified_base (469)..(469): a, c, t, g, unknown or other
  modified_base (474)..(474): a, c, t, g, unknown or other
  modified_base (487)..(487): a, c, t, g, unknown or other
  modified_base (500)..(500): a, c, t, g, unknown or other
  modified_base (502)..(502): a, c, t, g, unknown or other
  modified_base (507)..(507): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctccccctctcattctctgcacagtctctgtggcctcctatgagctgacacagccatactcagtgtcagtgtctccgggacagacagcaggatcacctgctacgaggagatagtaactaagggaaaaaaatgtcgacttcggttggtttacccaagccgaaggaacgggccgggccacggccccccctggtcttgatgtaaactttaataagacactgacgcggcctcgaggactcccgngacgtgacttcgccggctaccagcgcaaggtcaacnggtcaccttnacnncgngccggacngtgacgngngngcttntacttagtacgtnttcgttcgttcgngncacanactcgttgtg

SEQ ID NO: 398808 - DNA, 637 bp, Homo sapiens
  misc_feature: GZ8MTXP01EFLIM.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctcggacagacagccaggatcacctgctcaggagatagtaacgtaaggaaaaaaattgtagtcttcggtttggttcccaaggtccgaggaacgggccgggacccgacggtcccccccctggtcttagattagtaaatttaagaagacaacgtgaacggccggccctacgacgggactcccgtgacgcgtacttcgtccggctcgacgctacgagggtacctacgacggtacctaccgtttcgaaccctagtccgacgggtcccgggggaccccgtaaggggtttacgaaccgggtaagttcggggaaacggttccttaggtaaccgttttaacttacgttacggtttaacccttgttccggtcggtactaacggaactaacgttaagtttccgttaagggttaacg

SEQ ID NO: 398809 - DNA, 733 bp, Homo sapiens
  misc_feature: GZ8MTXP01C9O4C.51.52.E08.1.454.CMB.2.raw
  modified_base (237)..(237): a, c, t, g, unknown or other
  modified_base (264)..(264): a, c, t, g, unknown or other
  modified_base (288)..(288): a, c, t, g, unknown or other
  modified_base (687)..(687): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtcgcctcctatgagctgacacagccatactcagtgcagtgtctcggganagacagccaggatcacctgctcagganatagtaacgtaagggaaaaaaatntagtcttacggttggtttacccaggccgaaggaaacgggccggggacccgaacgggtccccccccccgttggttacgtttgaacgttaggtaaaattttaaagtaaacggaacctaacgttagggaacggcccgggtccccttacgaacggggtaccttccccggtaggaacggtccgtaacgtttcccgacccgggtccttaccgaacggtccttaccgaacggggtaaaccttacgacggggtttaccctaaacccgtttcggaaacccctagttacccggaacgggtcccgggggtaacccctaggggtttaccggaacggtacgttagggaacggtcgttacggtaaccttaatttaacccgttggtttaacccttcgttcggtaacccggggtnttaacggaaacccgttaaacttaagttttcggaacgggggtttaag

SEQ ID NO: 398810 - DNA, 650 bp, Homo sapiens
  misc_feature: GZ8MTXP01CX4GA.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtcggcctcctatgagctgacacagccatactcagtgtcagtcgtcgtccggacagacagccaggactcacctgctcgaggagatagtaacgtaaagggaaaaaaatgtagtacttcggttcggttacccgaggacgaaggaacgggccgggccgaccgggtcccccccttggttacttgataggtaaatttaacaagtacacgtaggacgccggaccctacgaacgggtacttcccgtaggacggtaccgtacgttcccgtcccgggtaccttaccgaacgccgttacgaacggggtaacttaccgacggggttaccctaaccgttacggaaccctagtaccgacgggcccgggacccgtagggttcgacgagtggaacggtcttaggtaacttagtttacgtcgtttaacttcgttcggtccggactcggaaacctacgttaacgtttcggaagggttaag

SEQ ID NO: 398811 - DNA, 600 bp, Homo sapiens
  misc_feature: GZ8MTXP01A0NVV.51.52.E08.1.454.CMB.2.raw
  modified_base (465)..(465): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtcgcctcctatgagctgacacagccatactcagtgtcagtgtccgtccgggacagacagccaggactccactgctcgaggagagtagtaacgtaaaggaaaaaatgtgtcttcggttggtccgagcgagacggccgccgacggcccccctgtctgactagtaaatttaagaagcacgtggacgtccggacctacgacgggtacctcccgtagacgtacgtacttccgtccggacctccgacgtcacgaaggacctaacgctcctaacttcgacctanccggacggcccgggaccgtagggttacgacgtagcggtaacgtcgttacgtacttaacgtttccgtcggtttaccttcgttcggccggtactaacggtaacctaaccgttaagtttccggttaagggttaaccgg

SEQ ID NO: 398812 - DNA, 638 bp, Homo sapiens
  misc_feature: GZ8MTXP01BGHXP.51.52.E08.1.454.CMB.2.raw
  modified_base (247)..(247): a, c, t, g, unknown or other
tcagcgatcgtatacacgaccggtgctcgatttagtcgagctctcagagagaaagggcacgaccggtgctcgatttagtcgagctctcagagaggaaagggggtaggctcaggaggcagagctctgattgtctcaccatggcctggactccctctcctgcctccccctcctcattctctgcacagtctctgtcgcctcctatgagctgacacagccatactcagtgtcagtgtcgtccggacagacngcaggatcactgctcgaggagatagtaacgtaaaggaaaaaatgtagcttacggttggttcccagcgaaggaacgggcggaccgacggtccccccctgttcgtgattagtaaatttaacgaagactacgtaggacgccggtacccgaggaacgggtacttcccgtaggacgtccggtaactttcccggcccgggtaccttacccgaacgtcccgttacggaaccggggtaaccttaccgtaaccggttacccgtaaccgttaccggaacctacgccggaacgggttcccgggacccgtgggttacgacgtacgtggaacggtcttagtacttactacgtcgttacgttcgttcgcggtctaacgaacaaccgttagttcggttggttaagg

SEQ ID NO: 398813 - DNA, 567 bp, Homo sapiens
  misc_feature: GZ8MTXP01CEC82.51.52.E08.1.454.CMB.2.raw
  modified_base (228)..(228): a, c, t, g, unknown or other
  modified_base (284)..(284): a, c, t, g, unknown or other
  modified_base (339)..(339): a, c, t, g, unknown or other
  modified_base (349)..(349): a, c, t, g, unknown or other
  modified_base (371)..(371): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctccccctctcattctctgcacagtctctgtggcctctatgagctgacacagccaatactcagtgtcagtntctcggacagacagccaggatcacctgctcaggagatgtactagggaaaaaaaatntagctcgttggttccagcagaagcggcaggcccccctgtcttgatgaatttaaanaagactacgngacgccggcctgacgtactccngagacgtactcgtaccgctacacgctacgacgacgtacgtacgtactacgtacgtacacgtacgacggaccgggccggtacggtacgtacgtacgtaggtaacggtacgttacgtaacgttaacgttaacgttacgttacgttcgttcgtccggtacgtaacgtaacgtaacgttaacgttaacgttaacggtaag

SEQ ID NO: 398814 - DNA, 740 bp, Homo sapiens
  misc_feature: GZ8MTXP01EEEKR.51.52.E08.1.454.CMB.2.raw
  modified_base (514)..(514): a, c, t, g, unknown or other
tcagcgatcgtatacacgaccggtgctcgatttagtcgagctctctcggcgggggctctgcttcagctgtgggcacaagaggcagcactcaggacaatctccagcatggcctggtctcctctcctcctcactctcctcgctcactgcacagggtcctgggcccagtctgtactgacgcacgccgccctgagtgtcgtcggggccccagggcagacggtcaccatcctcctgacacgtagggaaactacggttaccaacgaacgtcgggggactaagggttaataacgttcgtaacacgttacggtaacccaggtaccaaaccgttccgaacggaaaccacccgaaccccccctaaaattccccttacaacctttacccaatactaacttaaaccgaaacgtaaaaccgtcccccggggtccccgttaccggggggtaccctacggtaacccgtaacttccgtcgtacgggtacctaccgtaacgtccgtacgactacctctaccgccttcccgngtccacgtaccgcgttacgggtccaccgaagtacgttaggacggtacgggttaggaacgggtacttaggaaccttacgttaaccgttcgaccgttacggtacctaagtcgaacccgaagtaccggcgtcgttacggtcgttcggtttcgggttcgggtttaccggggttaacccggggcgggtaaccgaacggaccggttacccggtaaccgttaacccggtaacg

SEQ ID NO: 398815 - DNA, 686 bp, Homo sapiens
  misc_feature: GZ8MTXP01ES5W6.51.52.E08.1.454.CMB.2.raw
  modified_base (260)..(260): a, c, t, g, unknown or other
  modified_base (275)..(275): a, c, t, g, unknown or other
tcagcgatcgtatacacgaccggtgctcgatttagtcgagctctcagagagaaagggcacgaccggtgctcgatttagtcgagctctcagagaggaaagggggtaggctcaggaggcagagctctgattgtctcaccatggcctggatccctctcctgcctccccctctcattctctgcacagtctctgtcgcctcctatgagctgacacacgcctatactcagttgtcaggtcgtaccgtacggacagacagcaggacncactgctacgagganagtagtaaacgtaaaggtaaaaaattgtacgtacgttcggttacggttcccaagtacgaaggtaaccgggccgggaccgacggtccccccctggttacttagtaattaggttaaaactttaaacgaacgtaccgtacgtacggaacggcccggtacccgttacggaacggggtaccttcccggagacgcgttacctcggtcccggacttacgacgtcttacgacggtactacgtacggtctaccgttacgacctacgtacgccggaccgggtaccagggttacgacgtagtcggaacggtcttacggtaactttaaacttacggttacccgttaacgttccgggttacgtaacccgggttacaacccgttaaacgaaaccggtttagttccggggttaagggtttaaccgg

SEQ ID NO: 398816 - DNA, 484 bp, Homo sapiens
  misc_feature: GZ8MTXP02GF1TO.51.52.E08.1.454.CMB.2.raw
  modified_base (286)..(286): a, c, t, g, unknown or other
  modified_base (456)..(456): a, c, t, g, unknown or other
  modified_base (463)..(463): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtactagggaaaaaaatntgctcgttggttccagcagaaggcggccagacccccctgtcttgatgatttataagacactgagcgcctcagggatccctgagcgattctccggctccagctcgagggactacagtcacttgaccatcagcggggcccaggtgacgatgaggctgactattactgttacntgcgtcngaacaactaattcgtaggtaa

SEQ ID NO: 398817 - DNA, 494 bp, Homo sapiens
  misc_feature: GZ8MTXP02FO6R3.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtggcctcctatgagctgacacagccatactcagtgtcagtgtctccgggacagacagccaggatcacctgctcaggagatgtactagggaaaaaatatgctcgttggtccagcagaaggcggccaggcccccctgtctgatgattatagacacgtgacgcgcctagagggactccctgagcgtattcctccggctccagctacgagggactacagtccacgttgaccatccgagccggggccctaggtgacgatgacgctagactagttacctgttactctgcgctagacactaactcgtaggtaa

SEQ ID NO: 398818 - DNA, 510 bp, Homo sapiens
  misc_feature: GZ8MTXP02J3YEO.51.52.E08.1.454.CMB.2.raw
  modified_base (289)..(289): a, c, t, g, unknown or other
  modified_base (340)..(340): a, c, t, g, unknown or other
  modified_base (381)..(381): a, c, t, g, unknown or other
  modified_base (450)..(450): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcgaggagatgtaacgtagggaaaaaatntgctcgttggtccagcagaacggcggcacggccccctgtctgatgatttanagcactgagcggtcctgacgggactcccgtgacgcgattcnccggctccgagctcgaggactacgacgtcacttgaccctagccacgggccgggcctaggttcgacgagngacgcgtagtactactactacgtacgtcgtcgtcgcgtacgacactacgtacgtacgtag

SEQ ID NO: 398819 - DNA, 476 bp, Homo sapiens
  misc_feature: GZ8MTXP02GPO2T.51.52.E08.1.454.CMB.2.raw
  modified_base (455)..(455): a, c, t, g, unknown or other
  modified_base (472)..(472): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactagggaaaaaaatatgctcgttggttccagcagaaggcgggccagacccccctgtcttgatgatttataagcactgagcggcctcagggatcccgtgagcgattctccggctcagctcagggactacagtcacttgaccatcagcgggcccaggttgacgatgaggctgactatactgttaccntgcggctgacacatcgnggta

SEQ ID NO: 398820 - DNA, 594 bp, Homo sapiens
  misc_feature: GZ8MTXP02JIHW6.51.52.E08.1.454.CMB.2.raw
  modified_base (208)..(208): a, c, t, g, unknown or other
  modified_base (238)..(238): a, c, t, g, unknown or other
  modified_base (286)..(286): a, c, t, g, unknown or other
  modified_base (349)..(349): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtggcctctatgagctgacanagccatactcagtgtcagtgtctccggganagacagccaggatcacctgctcaggagatgtacgtaagggaaaaaatntagctcggttggttcccagcgaggaacggccggaccgacggcccccctgtctgatgtaattanaagacacgtgacgccggccctcgacgggactcccgtgacgcgtacttcccgtccggcctaccgagtcctcgaacgggaccttacgacgttaccacccgttacgaacctacgtaccgacggggacccggggaccccgtagggttacggaaccgtacgaggtaacgggtctaggtaacttacgtttaacgtcgttaaccctgtacggcgtaccgtagaaaccctaataccgtttacggaggttaacg

SEQ ID NO: 398821 - DNA, 641 bp, Homo sapiens
  misc_feature: GZ8MTXP02I414K.51.52.E08.1.454.CMB.2.raw
  modified_base (286)..(286): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtgcctcctatgagctgacacagccatactcagtgtcagtgtctcggacagacagccaggatcacctgctcaggagatagtacgtaagggaaaaaatntagctcggttggttacccagcgagaaggccggaccacggcccccctgtccttgactgtaatttaataagacactagacgccgccctacgagggactcccgtagacgtcgtacttccgtccggcctaccacgcctacgaacgggtacctacgtacgtaccctaaccgttcgaaccctacgtaccgaacgggcccccgggggtacccgtaacggggtttacggaaaccggtagtacggggtacggtaccgttacggtaactttaaacgttaacgtttcgtttaaacccgttcgttacggccgggttaccttaacggaaaacctaaacgttaaaacgtttccgtaagggtttaaaccg

SEQ ID NO: 398822 - DNA, 631 bp, Homo sapiens
  misc_feature: GZ8MTXP02JWG34.51.52.E08.1.454.CMB.2.raw
  modified_base (287)..(287): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtggcctcctatgagctgacacagccatactcagtgtcagtgtctccgggacagacagccaggatcacctgctcaggagatgtacgtagggaaaaaaatntagcttcgttggttccagcagaaggcggccaggcccccctgtctgatgatttataagacactgagcggccctgagggactcccgtagacgcgtacgttcgtccggcctaccgagtcctacgaaggggtacctacgtacggtacctaccgtttacgaccctagtaccgaacgggcccgggggaccccgtagggtttacggaacccggagttagggaacggggtccttacgggtaaccgtttaaatttaacccgttaggtttaaacccttccggttaggcccggggtactttaacgggaaaaccctaaaacccttaaaggttttcccggtacggggtttaaaacgg

SEQ ID NO: 398823 - DNA, 581 bp, Homo sapiens
  misc_feature: GZ8MTXP02JRDSU.51.52.E08.1.454.CMB.2.raw
  modified_base (269)..(269): a, c, t, g, unknown or other
  modified_base (512)..(512): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtcgtccgggacagacagccaggatcacctgctcgagganatgtaacgtaaggggaaaaaatgtagtcgttcggttcggttaccagtacgaggaaacgggccggaccgacggtccccccccgtgttcttagattagtaatttaagtaacgactacgtaggacgccggtccctacgacgggtacctcccgtagacgtcgtacttccgccggcctccgacgctacgaggacctacacgtcctaccgttgaccagtcgaacggcccgggccgtaggtcgacgtagnggacgtctagtacttagttactcgttactcgcggtcgcgttacgactaactaacgttcggaggttaacg

SEQ ID NO: 398824 - DNA, 522 bp, Homo sapiens
  misc_feature: GZ8MTXP02JFWJT.51.52.E08.1.454.CMB.2.raw
  modified_base (222)..(222): a, c, t, g, unknown or other
  modified_base (283)..(283): a, c, t, g, unknown or other
  modified_base (330)..(330): a, c, t, g, unknown or other
  modified_base (348)..(348): a, c, t, g, unknown or other
  modified_base (390)..(390): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtgcctcctatgagctgacacagccatactcagtntcagtgtctccgggacagacagccaggatcacctgctcaggagatgtactaggaaaaaatntgctgttgtccagcagagcggccacggccccctgtctgatgtattanagacactgagcgcctagnggactccgtgagcgtatcgtcgctcgagctcgaggactacgnggtacctaccgttacgacctaacgtcgaacggcccggggtaccctagggttacgacgtatggacggtcgtagtaaccttagtttacctgttactcgttgccggacttacgactaactaagttcgtaggtacg

SEQ ID NO: 398825 - DNA, 670 bp, Homo sapiens
  misc_feature: GZ8MTXP02HM35Q.51.52.E08.1.454.CMB.2.raw
  modified_base (180)..(180): a, c, t, g, unknown or other
tcagcgatcgtatacacgaccggtgctcgatttagtcgagctctcagagagaaagggcacgaccggtgctcgatttagtcgagctctcagagagaaagggggtagctcaggaggcagagctctgattgtctcaccatggcctggatccctctcctgcctccccctctcattctctgcacngtctctgtgcctcctatgagctgacacagccatactcagtgtcagtgtcctcggacagacagccaggactcacctgctcgaggagatgtaacgtaagggaaaaaatgtagcgttcggttcggttcccgaagcgaaggaaacggggtccggggacccgtaccgggtccccccccttggttccgtttaggatttaggttaaacttttaaagtaaacgggtaacctacgttacggacggcccgggtcccctacggacggggtaccttccccggtaggacgtcggtactttcccgtacccggtcctacccgacgtcctacgacgggtacctaccgtagttaccctaccgttacgaaccctagtaccgacgggtcccggggtacccgtagggttacgaaccgtgtacggtacggtcgttacgtaacgtttacttaccgttacgttactcgttcggcgtacttacgaaacctaacgtacgttacggtacggtaacg

SEQ ID NO: 398826 - DNA, 594 bp, Homo sapiens
  misc_feature: GZ8MTXP02ICTPX.51.52.E08.1.454.CMB.2.raw
  modified_base (152)..(152): a, c, t, g, unknown or other
  modified_base (220)..(220): a, c, t, g, unknown or other
  modified_base (359)..(359): a, c, t, g, unknown or other
  modified_base (393)..(393): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctntcctgcctccccctcctcattcctctgcacagtctctgtggcctcctatgagctgacacagccatacnagtgtcagtgtcctccgggacagacagccaggatcgacctgctcgaggagatgtaacgtaaggaaaaaatgtagctcggttgttaccgagcgaaggaacgggccgggccacggccccccctgtcttgatgtaatttaanaagacacgtgacgccgccctagagggactcccgngacgcgtattccgtccggctaccgagtcctacgaggaactacgcgtactaccttacgacctagtccgaacggccggggtcccgtaggttcgaaccgtagtaggaacggtccgttaggtactttaacgttacgttacggttaaccttccggacggtccggtacctaacgaaacctaaacgttacgtttacggtacggtaacg

SEQ ID NO: 398827 - DNA, 604 bp, Homo sapiens
  misc_feature: GZ8MTXP02II6NI.51.52.E08.1.454.CMB.2.raw
  modified_base (224)..(224): a, c, t, g, unknown or other
  modified_base (267)..(267): a, c, t, g, unknown or other
  modified_base (288)..(288): a, c, t, g, unknown or other
  modified_base (411)..(411): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtntcagtgtctccgggacagacagccaggatcacctgctcagganatgtacgtaagggaaaaaatntagcttcggttcggttacccagacgaggaaacgggccgggaccacggtccccccctggtcttagattgtaatttaataacgactaacgtaggacgcccgggtacctcggagggtacctcccgnggacgcgtagttcccgtccggcctccagcctacgacgggtactaccgtacgtcctaccgttacgacctacgtcgacgggccgggtaccgtagggtacgtacggtaagcggaaggtcgtacgaacctttaattacgttcgttactcgttcgccggtacctaaggtaacctaaaataccgtttcgaaggttaacg

SEQ ID NO: 398828 - DNA, 799 bp, Homo sapiens
  misc_feature: GZ8MTXP02GU3S0.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggactcacctgctcgaggagatgtaacgtaagggaaaaaaatgtagtcgttacggtttcggtttacccaggaccgaaggaaacggggcccggggacccgtaaccggggtccccccccttagggttaccgtttacggtaagttaggttaaattttaaacgtaaaacggtacctaaaccgtttacgggaaacgggtcccggggtacccccgtttacggaaaccgggggtaaacccgttcccccggttacggaaacggtacccggtaacgttttcccgaccccggggtcccttacccgtaacggcccgttaccggaaacggggtaaccttaaaccgtacggtttacccaaacccgtttcggaaaaccctcgttacccggaacggggtcccgggggacccctaagggggtttacccgaacggttaagcgggtaaacgggtcccgttagggtaaaccctttaagttaaccgtttcgttaaacccgttcggttaccgaacgggtaccctttaggaaaacctaaaacggtttaccttacggttacgggtttaaacgg

SEQ ID NO: 398829 - DNA, 548 bp, Homo sapiens
  misc_feature: GZ8MTXP02HVC4U.51.52.E08.1.454.CMB.2.raw
  modified_base (293)..(293): a, c, t, g, unknown or other
  modified_base (357)..(357): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattcctctgcacagtctctgtggcctcctatgagctgacacagccatactcagtgtcagtgtcctcgggacagacagccaggatccactgctcgaggagagtgtaacgtaaagggaaaaaatntgcttacggttcggttaccagacgaggacgggccgggcacggcccccctgtctgatgtattaanagcacgtgacgccgcctacgacgggtactcccgtgagcgtacttccgtccggcctcacgcctacgacggactacgatcctacttcgacacgtcgacggccgggacctaggttcgacgagtggacgtcgtagactttagttactacgttctcgtcggcgtcctagtaacgaacttaacttcggtagggtaag

SEQ ID NO: 398830 - DNA, 574 bp, Homo sapiens
  misc_feature: GZ8MTXP02GM83B.51.52.E08.1.454.CMB.2.raw
  modified_base (464)..(464): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtcgcctctatgagctgacacagccatactcagtgtcagtcgtcgtcccgggacagacagccaggatcacctgctcgaggagatagtaacgtaaagggaaaaaaatgtagcttcggttcgtacccagcgaaggaacgggcggaccgacggcccccctgtccttaggattagtaatttaaacaagacacgtagacgccgaccctacgagggtacctcccgtgacgtcgtactccgtccgctcagcacgacggactacgacgtcctacgtacaccacncgacggccgggacccgtaaggtcgaacgagtcggaggtctacggtaccttaattaccgttatttaaccgcgttacgcggtcctaagaacctatactacggtaggttaacg

SEQ ID NO: 398831 - DNA, 609 bp, Homo sapiens
  misc_feature: GZ8MTXP02GR9CC.51.52.E08.1.454.CMB.2.raw
  modified_base (221)..(221): a, c, t, g, unknown or other
  modified_base (234)..(234): a, c, t, g, unknown or other
  modified_base (281)..(281): a, c, t, g, unknown or other
  modified_base (339)..(339): a, c, t, g, unknown or other
  modified_base (382)..(382): a, c, t, g, unknown or other
tcagcgatcgtatacacgaccggtgctcgatttagtcgagctctcagagagaaagggcacgaccggtgctcgatttagtcgagctctcagagagaaagggggtagctcaggaggcagagctctgattgtctcaccatggcctggactccctctcctgcctccccctctcattctctgcacagtctctgtgcctctatgagctgacacagccatactcagtncagtgtctcgganagacagccagatcactgctcgagagatagtacgtaaggaaaaaaatntagtctcggttgtacccgagacgaggaacggcggaccgtacgcccccctgtctgagtntaattaataacgacacgtgacgtccggcctagagggactccgngaagcgtacttccgtccgcctcgagccgacgacggtacctacgtacgttcctaccttacggaccaacgtccggaacgggccccgggggttaccccgaagggtttacccggacgtaaagggtacggtacggttacgttaacgtaacctttaacgtttaccgttcgttaccgtcgtacggtaacggtactaaacgtaaacctaacgttaacggttcggtaacggtaacg

SEQ ID NO: 398832 - DNA, 661 bp, Homo sapiens
  misc_feature: GZ8MTXP02IB9WW.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtcgcctcctatgagctgacacagcctatactcagtgtcagtcgtccgtccggacacgacacgccgaggactccacctgctacgaggagtagtagtaacgtaaagggaaaaaatgtgtcgttcggttcggttaccgaggacgaagggaacgggccggggacccgacggtcccccccgtgtccgttgtaattaggttaaatttaaacgtaacgtactacgtacggaccggtccgtacccgtacgacggggtaccttcccgaggacgtccgttacgttcccgtccggtctaccgacgtccgtacgaggacctacgtacgtactaccgtacgaccagtccgacgggccggtaccgtagggtacgacgtagacggtacgcgttagtaaactttcgtttacgttacgtttaccgttcgtacgggtcccggtattaacgaaaccgttaaaccgttagtttaccggttaagggtaaccgg

SEQ ID NO: 398833 - DNA, 589 bp, Homo sapiens
  misc_feature: GZ8MTXP02F56H2.51.52.E08.1.454.CMB.2.raw
  modified_base (238)..(238): a, c, t, g, unknown or other
  modified_base (242)..(242): a, c, t, g, unknown or other
  modified_base (344)..(344): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtggcctcctatgagctgacacagccatactcagtgtcagtgtctcggacngacngccagatcacctgctcaggagatagtacgtaaggaaaaaatgtgcttcggttggttacccagcgaaggaggccggccgacggccccctgtctgatgtattanagacatgacgccgcctcgaggctcccgtgagcgtacttccgccggcctcgacgtctacgagggtacctacgcgtaccctaccttacgacctacgtaccggacggtcccggggaccccgtaagggttcgaaaccggtgttacggaacggtctagggtaacctttaacgtttaccggttacgttaccgttcgttcgggccgtacgttacggaaacccctaagtttaccgttaggtaacgggttacgg

SEQ ID NO: 398834 - DNA, 639 bp, Homo sapiens
  misc_feature: GZ8MTXP02F1SMT.51.52.E08.1.454.CMB.2.raw
tcagcgatcgtatacacgaccggtgctcgatttagtcgagctctctcggcgggcacgaccggtgctcgatttagtcgagctctcagagagaaaggggagcatcacccagcaaccacatctgtcctctagagaatcccctgagagctccgttcctcaccatggactggacctggaggatcctcttcttggtggcagcgaaccacaggacgcccactcccgaggtcgcagctggtgcagtctggggactgaggtgagagcctgggcctcagtgaaggtctcctgcaagacttctggactacaccttcaccgactacgtatatgcacgtgggtgccgacgaggcccctggaccaaggggcttggagtggaagtggggactggggactaccgtaacccgtaagtaaacgtaggtacggaccgaaacaaaaccgtaattactacggggggggaactaacggtaacttttacgtaacgggtacgttcggggttacgtaccgaacttacggaaccgaacggaccggaccgaaacgaacgttactaacgaaccaaaaccgaactaacgtactaacgtacgtacggtaggttacgaaccgaacgtacccgtacgacccgaccggaccggtacccggtcgttttaacgg

SEQ ID NO: 398835 - DNA, 682 bp, Homo sapiens
  misc_feature: GZ8MTXP02IQBVK.51.52.E08.1.454.CMB.2.raw
tcagcgatcgtatacacgaccggtgctcgatttagtcgagctctcccgcgggcacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagcgtggtgcagtcgtgggactggaggtagaagaagccgtggggcctcgagtgaacggtctccgtgactaagtactttcgtagggtaactaccgtaacccttccaacccgtactaacttataagtgaccgtaacgttggggtacgaccggacccgaccgggtcccccgtagggaaccgtaacggggtccttaggagggttgggaggtgggggattggggaactaccggtaacccgtaaaggaacgtcggtacgaccaaactaaacgtagtacgactaacgacgttaccgtttacgaggggtccgttacgggtaccaccgtagtccgaaacccgacgaccgaaccactacgtacctaacgacaaaccgtacgacgttactaacgtaggtaggtacgttacgaacccgagtaacccggtcgaacccggtacgaccgggtaccgttaggttttacgttttgg

SEQ ID NO: 398836 - DNA, 694 bp, Homo sapiens
  misc_feature: GZ8MTXP02HTUVT.51.52.E08.1.454.CMB.2.raw
  modified_base (203)..(203): a, c, t, g, unknown or other
  modified_base (245)..(245): a, c, t, g, unknown or other
  modified_base (251)..(251): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatganctgacacacgccatactcagtgtcagtgtcctcggacagacngcagcncgactgctcgagagatagtaaacgtaaaggtaaaaaatgtagtacgttacggttcggttaccgagacgaaggaacgggccgggaccgaccggtccccccgttagtccgttagagttagttaaactttaaagaacgtacgtactagggacgtcccggcccgtacggtacgggaccttacccgtaggtacgccgttacgttcccgtaccgggtcccttaccgacgtaccctacgggaaccggtaaacctccgaacggttacccttaaccgttacgaacccgttacgacccgggaaccggggcccggggtacccgttagggttacggaaaccgtacggaggtacggacttacggtaactttaacgtttaacgttccgtttaaccgtcgttacggaaccggttacctaaaggaacccctaagtttaaccgttcggtaaggttaacgg

SEQ ID NO: 398837 - DNA, 574 bp, Homo sapiens
  misc_feature: GZ8MTXP02FHOVG.51.52.E08.1.454.CMB.2.raw
  modified_base (534)..(534): a, c, t, g, unknown or other
  modified_base (566)..(566): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctcccccctcctcattctctgcacagtctctgtggcctcctatgagctgacacagccatactcagtgtcagtgtctccgggacagacagccaggatcacctgctcgaggagatagtaactaagggaaaaaaatgtgcttcggttggttacccagcgaaggaaacgggccggggacccacggcccccccctgttcctagactgtatttaataacgacacgtgacgccggccctacggacgggtactcccgtaggacgtacgtacttccgtccggctaccgacgtcgacgacgggtactacgacgtcctaccttcgaacctatccgacggccgggccctaggttgacgtgagacggctagtactattactacgttacncgttcggcgtctacgaactaactacgttacgngggtaacg

SEQ ID NO: 398838 - DNA, 644 bp, Homo sapiens
  misc_feature: GZ8MTXP02FVS7X.51.52.E08.1.454.CMB.2.raw
  modified_base (265)..(265): a, c, t, g, unknown or other
  modified_base (289)..(289): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtcgcctctatgagctgacacagccatactcagtgtcagtgtcgccggacagacagccagactcactgctacgagganagtagtaacgtaaaggaaaaaatntgtcgttcgttcgtaccagcgaaggaacggccggaccgacggtcccccctgttcgttagtattagtaatttaagaacgacacgtagaccgcccggtacccgtacggacggtacctcccgtagacgtacgtacgtttccgtcccggctaccgacgtccgttacgaacgggtaacctacgtaccgttaccgtaccgttcgaacctacgtaccggacggggtccccggggtacccgttagggttacggaaccggtagtacggaacggttcgtaacgtaacgtttaactttacggttacttaccgtcgttacggccgtacgtacgtaaacctaacgttacgtttacggtaggttaacgg

SEQ ID NO: 398839 - DNA, 603 bp, Homo sapiens
  misc_feature: GZ8MTXP02JC0TM.51.52.E08.1.454.CMB.2.raw
  modified_base (266)..(266): a, c, t, g, unknown or other
  modified_base (286)..(286): a, c, t, g, unknown or other
  modified_base (342)..(342): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtcggcctcctatgagctgacacagccatactcagtgtcagtgtctccggacagacagccaggatcacctgctcagganatgtactaagggaaaaaatntagctcgttggttaccagcagaaggccggcacggccccctgtctgatgtaatttanaagacacgtgacgccggcctagacgggtactcccgtagacgcgtattcctccggactccgagtcctacgagggtactacgagtacctaccttcgacctagtccgaacgggccggggtaccctagggttacgaaccggtagtacggacggtacgtacggtaaaccctttaagttaccgtttacggttacccttccgttcggaacccggtttacaacggtaaaacctaaaacgttacgtttaccggtaagggtttaaacccgg

SEQ ID NO: 398840 - DNA, 674 bp, Homo sapiens
  misc_feature: GZ8MTXP02G3ZYV.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtcgcctcctatgagctgacacagccatactcagtgtcagtgtccgtccgggacagacacgaccaggactcacctgctacgaggacgtagtagtaaacgtaaagggaaaaaaatgtacgtcgttcggtttacggtaccgaggacgaagggaaacggggcccgggacccgaaccggtccccccgttagtccgttagattagttaatttaaagaacgtacacgtaggaccgcccgggtacccgtacggacgggtacttccccggtaggaccgtaaccgttacgtttccccgtaccccgggtccttacccgaggtaccccgtacggaacggggtaacctaccgtacgttcccaaccgtttacggacctacgtaccgacggggcccgggtaccgtacgggtcgaacgtcgtaggacggtctacgttacttagtttacgtcgttacgcgttcggaaccgtagtacaaactacgttacgtcggtaggtaacg

SEQ ID NO: 398841 - DNA, 548 bp, Homo sapiens
  misc_feature: GZ8MTXP02H83AF.51.52.E08.1.454.CMB.2.raw
  modified_base (245)..(245): a, c, t, g, unknown or other
  modified_base (373)..(373): a, c, t, g, unknown or other
  modified_base (432)..(432): a, c, t, g, unknown or other
  modified_base (446)..(446): a, c, t, g, unknown or other
  modified_base (484)..(484): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctccccctcctcattctctgcacagtctctgtggcctctatgagctgacacacgcctatactcagtgtcagtcgtcgtcggacagacngccaggactccaccgtgctacgaggagagtagtaacgtaaagggaaaaaatcgtagtacttcggttacgtccgagacgaaggaacgggccggaccgacggtcccccctagtcgttgatgtaatttaanaggactacgtgaccgccgtccgtacggacggtactcgagtacgcgtactcgaccgctcncgctcaggactacncgactctacgacacgtgacggtcggactggtcaacgtnaggtcgtctagtacttactacttcgtactcgtgcgtacacgactaaacgtgttacgtagggtac

SEQ ID NO: 398842 - DNA, 655 bp, Homo sapiens
  misc_feature: GZ8MTXP02FYY8E.51.52.E08.1.454.CMB.2.raw
  modified_base (292)..(292): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtcgtccgggacagacagccaggatcacctgctcgaggagatagtaacgtagggaaaaaaatntagtcttcggttaggttcccaggcgaaggaacgggcgggaccgacggccccccccgttagtccgttagtacttagtaatttaagtaacgaacaacgttaggaaccgggcccgggtaccctacgggacgggtaccgtcccgtaggacggtacgtattcccgtccggacccttccgacgtcctcgaacgggacctaccgagttaccctaccttacgaacctacgttaccggacgggcccgggggtaccctaaggggtttcgaaccggagttagggaaccggtcgtacggtaacttaacttacgttacgttacttcgtacggccggttcaacgtaacgtaacgttaagttccggtaggtaaaccgg

SEQ ID NO: 398843 - DNA, 790 bp, Homo sapiens
  misc_feature: GZ8MTXP02GCES5.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattctctgcacagtctctgtcggcctcctatgagctgacacagccatactcagtgtcagtcgtcgtccggacagacagccaggctccacctgctacgaggagagttacgtaacgtaaagggtaaaaaatgtacgtcgtttcggtttacggttacccaaggtacgaaagggaaaccggggccgggaccccgtaacccggggtccccccccgttggttaccgtttacggtaacgtttagttaaaacgttttaaacgttaaacggaccgttaacggtacgggacccgggtacccccgggttaccccgtaccggggtaaaccgggggttaacccttccccggttaagggtaacccgggtaacgtttcccggttttcccccggaccccggttccccgtttaccggaaaccgggtttcccgtaaccggaaacgggggttaaacccttaaaccgtccggttaccccttaaccgttacgaacccgtaccgttaccgggaccggggtaccccggggtacccgtagggttacgaaccggtagtcgggaacggtcttagtaacgtttactacgtttctaaccgttgccggtcgtaccgtacaaaccgttaagtacgttggtacggttaacgg

SEQ ID NO: 398844 - DNA, 506 bp, Homo sapiens
  misc_feature: GZ8MTXP02FPL5T.51.52.E08.1.454.CMB.2.raw
  modified_base (288)..(288): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctcccccctcctcattctctgcacagtctctgtggcctcctatgagctgacacagccatactcagtgtcagtgtctccgggacagacagccaggatcacctgctcaggagatgtactagggaaaaaaatntgctcgttggttccagcagaaggcggccaggccccccctgtctgatgatttatagacactgagcgcctcgagggactccctgagcgattccgtccggctccagctcgagggactacagtccaccttgaccatccgaggccggggccctaggtgacgatgaggctgacttattaactgttactctgcggtctacgaacaacgtaacttcgtaggtaacg

SEQ ID NO: 398845 - DNA, 699 bp, Homo sapiens
  misc_feature: GZ8MTXP02IOVC4.51.52.E08.1.454.CMB.2.raw
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgcctccccctctcattcctctgcacagtctctgtgcctctatgagctgacacagccatactcagtgtcagtgtctccggacagacagccaggactcacctgcctcgaggagatgtacgtaaaggaaaaaatgtagtcttacggtttcggttacccagtacgaacggaaacgggtccggggacccaccgggtcccccccttacggttccgtttaggaagttaggtaaacttttaaacgaacggtacctaaacgttcgggaacggtccccgggtaccctacggaacggggtacctccccggtagaaccggtacgtacgtttacccgtcccggtacccgttaccgacgtccgttacgacggggtacctacgtacgtaccgtaccgttacgacgtacgtccgacgggaccggggtaccctagggttacgaacgtagtacgggtacggtcgttacgtacgtttaacgtttaccgttacggtttaacctcgttacggtaaccgtacgttaaccggaacctaaacgtacctttacggtacggttaaaccgg

SEQ ID NO: 398846 - DNA, 743 bp, Homo sapiens
  misc_feature: GZ8MTXP02IYRB1.51.52.E08.1.454.CMB.2.raw
  modified_base (202)..(202): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtgcctcctatganctgacacagccatactcagtgtcagtgtccgtccgggacagacagccgaggatcacctgctacgaggagagtgtaaacgtaaagggaaaaaaatagtagtacgttacggtttacggttacccaggtacgaacggaaacggggcccggggacccgaaccggtccccccccgttagttccgtttacggtaagttaggttaaaacttttaaacgtaaacgtaacccgtaacggttacggaaaccgggtcccccgggtacccccgtaaccgggtaacggggtacccgtttacccccggtaggtaccgggtacccgttaaccgtttcccggtaccccgggttcccttacccgaacgtccgtacgaacgggtaaccttaaccgtacgttaccctaaccgttacgacccgtaaacgtcccggacgggtaccccggggtacccgtaagggttacgaaccgtagtcggaaccgtcgtacggttaccttaagttacgttacgttacgtcgtacggtcgacgttacgaacgtactaacgttcgtaggtaacg

SEQ ID NO: 398847 - DNA, 542 bp, Homo sapiens
  misc_feature: GZ8MTXP02JBYPD.51.52.E08.1.454.CMB.2.raw
  modified_base (287)..(287): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtactaagggaaaaaatntagctcgttggttaccagcagaaggcggccacggcccccctgtctgactgtattatagcactgagcgcctgagggactcctgagcgattccgccgctccagctacgagggtacctacgacgtcctaccgtttacgacctagtcgaacggcccgggggccccgtaagggttcgacgtaacgtcggaacggtctagtacgttattaccgttcgttactcgtcggcgcttacgacaactaacgttccgtagggtaacg

SEQ ID NO: 398848 - DNA, 593 bp, Homo sapiens
  misc_feature: GZ8MTXP02JR7FG.51.52.E08.1.454.CMB.2.raw
  modified_base (252)..(252): a, c, t, g, unknown or other
tcagcgatcgtatacacgaccggtgctcgatttagtcgagctctctcggcgggggctctgcttcagctgtgggcacaagaggcagcactcaggacaatctccagcatggcctggtctcctctcctcctcactctcctcgctcactgcacagggtcctgggcccagtctgtactgacgcagccgcctcagtgtcgtcggggccccagggcagagggtccaccatctcctgcacgtgggaactacgttaccaanacgtcgggactaggttataatgtacacgtgtaccagacaacttcgaggaacacgaccccaaactctacactccatgactacagaatcccgccgtcggggtcctcgactacttctcgtcgtctacagtctagacctacttcaccgtccctacccgtcggacccagtaccacgtcgggacccttacgaacgtaccgtagggtacgtaacgtcgacgggtactacggtaacttacttaacgtcgtaccgtaacggttaccagtacgaaccgtagcccgaggtctagacgtcgtcgttcggttgggttaaccggcgggacggtaccaacgcgtacgaccgtaccg

SEQ ID NO: 398849 - DNA, 694 bp, Homo sapiens
  misc_feature: GZ8MTXP02I0RI7.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctcccccctctcattctctgcacagtctctgtggcctcctatgagctgacacagccatactcagtgtcagtgtctccggacagacagccaggatcacctgctcgaggagatagtaaacgtaagggaaaaaaaatgtagtacgttcggttaggtttacccagacgaaggaaacgggccgggaccgacggtccccccctgtaccgttagaacgttagtaaattttaaagtaaacgtacctaacgttacggaaacgcccgggtaccccgttacgggaacgggtaccttacccccgttaggaacgtaccgtacgtttcccgtacccgggtccttacccgaagtccgtaccgagggtaaaccctaacgtaacgtaccctaaccgttacggaacctacgtaccgacggggtcccggggacccgtaagggttacgaaccgtacgagtaccgggtcttaggtaaccttaagtttacttacgttacgtacgttcgaaccggtacttacggaaaactaaacgttaacgtcggttaacggttaacgg

SEQ ID NO: 398850 - DNA, 702 bp, Homo sapiens
  misc_feature: GZ8MTXP02IW9M7.51.52.E08.1.454.CMB.2.raw
  modified_base (414)..(414): a, c, t, g, unknown or other
tcagcgatcgtatacacgaccggtgctcgatttagtcgagctctcagagagaaagggcacgaccggtgctcgatttagtcgagctctcagagagaaagggggtagctcaggaggcagagctctgattgtctcaccatggcctggatccctctcctgcctccccctctcattcctctgcacagtctctgtcgcctctatgagctagaccacagcctaatactcagtgtcagtcgtccgtcgggacagacacgccgagactcactgctacgaggatagtagtaaacgtaaaggtaaaaaatcgtacgtccgtttacggttacggttaccgacggacgaaacgggaaccgggtccggggacccgtaaccgggtcccccccttaggtaccgttagaagtttaggttaaacttttaaanaacggtacctaacgtacggaccggtacccggtacccgttaggaaaccgggtcttaccccgtaggaacgttccggtaactttcccggccggttcctaccgacgttacctaccggaacggtacctaacgtacgtacttaaccgttcgaaccacgtccggaccggtaccgggtaccgtaggtaccgaggttaacggtaggtacgtacgtaacgtaacgttacgttacgttacgtacgtcggtacgtaacgtacgtaacgtaaccgtaacgtacggttacggtacggttacg

SEQ ID NO: 398851 - DNA, 664 bp, Homo sapiens
  misc_feature: GZ8MTXP02HV93J.51.52.E08.1.454.CMB.2.raw
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggactccctctcctgcctcccccctcctcattcctctgcacagtctctgtcgcctcctatgagctagacacagcccatacctctagtcgtcagttgtccgtaccgggacaacgaccagaccgaggtactccacctgcctcgaaggagtagtagtaaacggtaaaggtaaaaaactgcgtcgttcggttggtccaaggcgaaggaacgggcccggaccgacggtcccccctgtacgttgtattagttaatttaagaacgtactacgtggaccgccggtcctacggacgggacctccgtagacgtcgtaccttccgtcccggtcctacgacgtccgtacgaacggacctacgtaacgttcctaaccgttccgaacgtcgaccgggtaccggggaccggtcccggtaaggttaccggacgtagtaacggtcggtaccttaggttaccttaatttaccggttccgttaactcggtaccggtctacgtaaccgaaccttaacggtaactttggtaacggttaacgg

SEQ ID NO: 398852 - DNA, 613 bp, Homo sapiens
  misc_feature: GZ8MTXP02IP4KE.51.52.E08.1.454.CMB.2.raw
  modified_base (282)..(282): a, c, t, g, unknown or other
  modified_base (335)..(335): a, c, t, g, unknown or other
tcagcgatcgtatacacgaccggtgctcgatttagtcgagctctcagagagaaagggcacgaccggtgctcgatttagtcgagctctcagagagaaaggggtaggctcaggaggcagagctctgattgtctcaccatggcctggatccctctcctgctccccctctcattctctgcacagtctctgtgcctcctatgagctgacacagccatactcagtgtcagtgtctccgggacagacagccaggatcactgctcaggagatgtacgtaaggaaaaaatntgcttcgttgttcccagcagacggcggccacggccccctgtctgatgtattanaagcagtgacgccggcctacgacggggtactcccgtaggacgtcgacgtttcccgcccggccttaccacggccttacggacgggtaacccttacgacggtccctaccgtttacggaccctagtaccgacgggcccgggggtaccccgtaggggtttacgaaaccggtgtcggtaaacggtccgttagtaaaccgtttactttaccgttcgtttaaccgtcgttacggtccgtacgttacggaaacctaaccgtaaagtttccggtagggtttaaaccg

SEQ ID NO: 398853 - DNA, 675 bp, Homo sapiens
  misc_feature: GZ8MTXP02IM99B.51.52.E08.1.454.CMB.2.raw
  modified_base (182)..(182): a, c, t, g, unknown or other
  modified_base (201)..(201): a, c, t, g, unknown or other
  modified_base (245)..(245): a, c, t, g, unknown or other
  modified_base (422)..(422): a, c, t, g, unknown or other
  modified_base (582)..(582): a, c, t, g, unknown or other
tcagcgatcgtatacacgaccggtgctcgatttagtcgagctctcagagagaaagggcacgaccggtgctcgatttagtcgagctctcagagagaaagggggtaggctcaggaggcagagctctgattgtctcaccatggcctggatccctctcctgcctccccctctcattcctctgcacngtctctgtgcctctatganctgacacagccatactcagtcgtcagtcgtccgtcggacagacncgccagactccaccgtgcctcgaggacgtatacgtaacgtaaagggaaaaaaattcgtacgtcgtttacggtttacggtttacccgaggtccgaaagggaaaccggggcccgggacccgtaaccggtccccccccgttagtttccgtttcggaagtttacgttaaacgtttttaaanaaaccggtacgtaacgtaccggtaaccgtcccggtacccgttacggacgggtaccttcccgaggttacgacgtacctttccgccgtcctacgacgtcctacgacgtacgtactcgtacctaccttcgacacgtccgagggtccggccgtaggtcaggtanacgggtacgaccgttaggtaccttaagtacgttcgttactccgtggtaaccggtctacggtaaacctaacgtttcgttaccgtagggttaaac

SEQ ID NO: 398854 - DNA, 669 bp, Homo sapiens
  misc_feature: GZ8MTXP02JJUBH.51.52.E08.1.454.CMB.2.raw
  modified_base (235)..(235): a, c, t, g, unknown or other
  modified_base (246)..(246): a, c, t, g, unknown or other
tcagcgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactgaggtgaagagcgtgggctcgagtgagtcnctgcagactcngatacaccttcaccgactactatatcgacacgtgggtcgaccggaaccgtacggtcccccgtagggaccgaaaggggtcttagggaaggttacgggagtggggacgttagggacccttaccggaaacccgtaaagaaacgttgggtaccgacccaacgtaaaccgtatacggtaccaacgtacgtttaccgttttacggaacggggtccgtagggtacccaccgtacgtcgaaccgacgtccgaacaccgtagtactaacggacaaacgtaccgtaacgttacctaacgtagtacggtacgttaacgaccgtacgaccgtacgaccgaacgtaccggttccgttagtttacgttttgtacggttagacggttagttacgtttaacggaaactacgtaccgacgtaccgtaccgttgtacccgg

SEQ ID NO: 398855 - DNA, 788 bp, Homo sapiens
  misc_feature: GZ8MTXP02GNZMO.51.52.E08.1.454.CMB.2.raw
  modified_base (252)..(252): a, c, t, g, unknown or other
  modified_base (281)..(281): a, c, t, g, unknown or other
tcagcgatcgtatacacgaccggtgctcgatttagtcgagctctcagagagaaagggggagcatcacccagcaaccacatctgtcctctagagaatcccctgagagctccgttcctcaccatggactggacctggaggatcctcttcttggtggcagcaaccacaggacgcccactcccaggtgcagctggtgcagtctgggactggaggtgaagaagcgtggggcctcagtagaggtctctgacaagcttnggactacaccttcaacccgtactactatntcgactacggttgggcgaccgaccgaccgggtaccccttgggaaacggtaaggggtcctttaggaggtaggaacggtgggacgtacggtaccgtacccgtaaacccgtaaggtaaacggtcggtaaccgaacctaaccgtaaactaacgtacgaaccgtaaacttaacgggttaacctttttacgggaacgggggttaccgttaccgggggtaaccctaaacgtaccggttaccgaaacccgaccgggtaacaaccccgtaaacggtaaccttaacccgtaacggaaccctaaaaccggaacttacggggtaaacccttaacgaggttaccggtacgttaaccccggacgtaaccggacccgttaccgggaacccgtaaccgggtaccgggttacccggtttacggttttacggtttagtacggggttaagtaaccggttggtttaacgttaaacggtaacctaaacggttccggaacggtaccgtaacccggttcgggtttaccgg

SEQ ID NO: 398856 - DNA, 358 bp, Homo sapiens
  misc_feature: GZ8MTXP01A8KQV.38.2.A02.1.454.CMB.2.raw
  modified_base (355)..(358): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtcttcccctggcaccctcctccaagagcacctctgggggcacagcggccctgggctgcctggtcaaggactacttccacgtgatcgactgagcgggctgggcaaggcgcatagnnnn

SEQ ID NO: 398857 - DNA, 543 bp, Homo sapiens
  misc_feature: GZ8MTXP01D3P67.38.2.A02.1.454.CMB.2.raw
  modified_base (349)..(349): a, c, t, g, unknown or other
  modified_base (539)..(543): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtaccaagaaccagttcctccctgaagttgacctctgtgaccgccgcagacacggccgtatattactgtgcgagagataaagtgttaattactacaattgttccctatactttgactacncggggccagggaccctggtcaaccgtctcctcagccctccaccgaagggcccatcggtccttccccctggccaccctcctaccaagacgccacctcgtcgggggcacgacgggcggcccgtgggctgccctggtcaaggctacctcgacgtgaactcgactgaggcgggcttgggcaggcgactaagagnnnnn

SEQ ID NO: 398858 - DNA, 354 bp, Homo sapiens
  misc_feature: GZ8MTXP01AU3LR.38.2.A02.1.454.CMB.2.raw
  modified_base (350)..(354): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccacaagggccatcggtctcccctggcaccctctccaagagcacctctgggggcacagcggccctgggctgcctggtcaaaggctacttccacgtgatcgactgagcgggctggcaaggcgcatagnnnnn

SEQ ID NO: 398859 - DNA, 549 bp, Homo sapiens
  misc_feature: GZ8MTXP01C4V54.38.2.A02.1.454.CMB.2.raw
  modified_base (248)..(248): a, c, t, g, unknown or other
  modified_base (296)..(296): a, c, t, g, unknown or other
  modified_base (541)..(541): a, c, t, g, unknown or other
  modified_base (546)..(549): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttcnccctgaagttgacctctgtgacccgccgcagacacggcctatattacngtgcgagagataaagtggttatactaccaattgtccctatactttgactactcggggccagggaccctggtcaacccgtctcctcagccctccaccaagggccccatccggtccttcccctcggccaccctcctaccaacgacgccaccctcgtgggggccacgacgggccggcccgtgggcgtcgcctggtcaaacggctacttccacgtgaactcgactgagcgggcttgggcaagggcgacngtagnnnn

SEQ ID NO: 398860 - DNA, 553 bp, Homo sapiens
  misc_feature: GZ8MTXP01EFS69.38.2.A02.1.454.CMB.2.raw
  modified_base (524)..(524): a, c, t, g, unknown or other
  modified_base (549)..(553): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtccaaagaaccagttctccctgaagttgacctctgtgaccgccgcagacacggccgtatattactgtgcgagagataaagtggttatactaccaatgttcctatactttgactactggggccaggtaaccctggcaaccgtctcctcagccctcccaaccgaacggggcccctatccggtccttccccctggccacccctccctaccaacgacgccacctcgtcgggggccaccgacgggccggccctggggcctgcccgtggtacaaggactacttccacgtgaatcgactgngcgggcttggcgaaggcgcaatagnnnnn

SEQ ID NO: 398861 - DNA, 614 bp, Homo sapiens
  misc_feature: GZ8MTXP01AHCU1.38.2.A02.1.454.CMB.2.raw
  modified_base (611)..(611): a, c, t, g, unknown or other
  modified_base (613)..(613): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagccccagggaggggctggagtggatcgggagtatctatcatactgggagcacctactacaacccgtcctcaagagtcgagtcaccatatcactagacatgtccaaagaaccagttcctccctgaagttgacctctgtgaccgccacagacacggccgtatattactgtgcgagagataagtgtatacacatgttcctatacttgactacgtcgggccagggaccctggtccaaccgtctcctcacgccctccacgaagggcccatccggtccttcccctcggccaccctcctaccaacgacgccaccgtcgtcgggggccacgacggggcccgggcccgttcggggccgttcggcccgttcgggtaccgtaaacgggtacccttaaccgttaccccgtaccggttcggaacttccggaaccgttcgggacgggtccgggggccgttggggcccgaaaggggccgacgaacgtaggcgcgcgngng

SEQ ID NO: 398862 - DNA, 356 bp, Homo sapiens
  misc_feature: GZ8MTXP01ANN12.38.2.A02.1.454.CMB.2.raw
  modified_base (352)..(356): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtctcccctggcaccctcctccaagagcacctctgggggcacagcggccctgggctgcctggtcaaggctacttccacgtgatcgactgagcgggctggcaaggcgcatagnnnnn

SEQ ID NO: 398863 - DNA, 593 bp, Homo sapiens
  misc_feature: GZ8MTXP01EDZ9S.38.2.A02.1.454.CMB.2.raw
  modified_base (179)..(179): a, c, t, g, unknown or other
  modified_base (588)..(590): a, c, t, g, unknown or other
  modified_base (592)..(593): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggancacctactacaacccgtccctcaagagtcgagtcaccatatcactagacatgtccaaagaaccagttctccctgaagttgacctctgtgaccgccgcagacacggcctatattactgtgcgagagataaagtgttattactaccaattgttccctattactttgactacgtcggggccagggaccctggtccaacccgttctcctcacgccctccaaccgaaggggcccctatccggtccttccccctcggccacccctccctacccaacgacgccaccctcgtcgggggccaccgacggggccggccccgtcggggccttcggcccgttgggtccgaaacgggtacctaccttcccgacgttgaactcgacgtcggacggcgggcttcgggcgaagggccgcaagtgnnngnn

SEQ ID NO: 398864 - DNA, 583 bp, Homo sapiens
  misc_feature: GZ8MTXP01ETHZY.38.2.A02.1.454.CMB.2.raw
  modified_base (303)..(303): a, c, t, g, unknown or other
  modified_base (572)..(572): a, c, t, g, unknown or other
  modified_base (579)..(583): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtaccaaagaaccagttctccctgaagttgacctctgtgaccgcgcagacacggccgtatatactgtgcgaganataaagtggttaattactaccaattcgttaccctattactttgactacgtcggggccagggaaccctggtccaaacccgttctccctcaacgccctaccaacccgaaggggcccctaagtccggttcccttcccccgtcggcccacccctccctacccaaacgacgccacctcgtcgggggacaccgacggggccggcccgtcgggctcggccgtggtacgaacggctacgttccacgtgaatcgacgtgagcgggcttggcaagggcntaagagnnnnn

SEQ ID NO: 398865 - DNA, 554 bp, Homo sapiens
  misc_feature: GZ8MTXP01CJ9P8.38.2.A02.1.454.CMB.2.raw
  modified_base (247)..(247): a, c, t, g, unknown or other
  modified_base (441)..(441): a, c, t, g, unknown or other
  modified_base (542)..(542): a, c, t, g, unknown or other
  modified_base (547)..(547): a, c, t, g, unknown or other
  modified_base (549)..(550): a, c, t, g, unknown or other
  modified_base (552)..(552): a, c, t, g, unknown or other
  modified_base (554)..(554): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtcctcaagagtcgagtcaccatatcactagacatgtccaaagaccagttcnccctgaagttgacctctgtgacccgccgcagacacggccgtatattactgtgcgagagataaagtgttatactacatcgttcctatacttgactacgtcggggccaggggaccctggtccaaccgttctccgcagccctccacgaacgggcccagtccggtccttcccctggccactccctcctacccaagacnccacctcgtcggggcacggcgccggcccgtgggcctcgccgtggtcgacggtacctccttccgcgtcgattcgtacttggaggcgggcgttggcaagggcncgagngnngngn

SEQ ID NO: 398866 - DNA, 596 bp, Homo sapiens
  misc_feature: GZ8MTXP01CXTWR.38.2.A02.1.454.CMB.2.raw
  modified_base (297)..(297): a, c, t, g, unknown or other
  modified_base (306)..(306): a, c, t, g, unknown or other
  modified_base (590)..(592): a, c, t, g, unknown or other
  modified_base (594)..(594): a, c, t, g, unknown or other
  modified_base (596)..(596): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtccctcaagagtcgagtcaccatatcactagacatgtaccaaagaaccagttcctccctgaagttgacctctgtgacccgcgcagacacggcctatatacngtgcgaganataaagtgttaatacacaattcgtcctatactttgactacgtcggggccagggaccctggccaaccgtctcctcacgccctccaaccgaacggggccccaagtccggttcccttcccccgtcggcccacccctccctaccaaacgcgccgaacctcgtcgggggaccaccgacggggcccgggtccccgtcgggccgtcgcccgtgggtaccaaacggtacctaaccgttccaccgtgaactcgacgtcgaggcggggcgttcgggcaagggccgacaagtagnnngngn

SEQ ID NO: 398867 - DNA, 643 bp, Homo sapiens
  misc_feature: GZ8MTXP01DUC0F.38.2.A02.1.454.CMB.2.raw
  modified_base (205)..(205): a, c, t, g, unknown or other
  modified_base (308)..(308): a, c, t, g, unknown or other
  modified_base (635)..(635): a, c, t, g, unknown or other
  modified_base (637)..(637): a, c, t, g, unknown or other
  modified_base (640)..(640): a, c, t, g, unknown or other
  modified_base (642)..(642): a, c, t, g, unknown or other
tcagtcgatcacgtcacgaccggtgctcgatttagactcatctacagggtcttcggagacccctgtccctcacctgcaatgtctctggttactccatcagcagtggttactactggggctggatccggcagcccccagggaggggctggagtggatcgggagtatctatcatactgggagcacctactacaacccgtcctcaagngtcgagtcaccatatcactagacatgtccaaagaaccagttcctccctagaagttgacctctgtgaccgccgcagaccacggccgtatattactgtgcgaganataaagtgttatactacaattgtcctatacttgactacgtcgggccagggaccctggtccaacccgttctccgtcacgtcccctaccaaccgtaaggggttcccagttccggttcccttcccccgtcggccctacccctccctacccgaacgacgtcccaccgtcgtcggggaccaccgacggggcccggcccgttcggggcctcggcccgttgggttaccgaaacgggtaccttaacccgtttcccgaaccggtttggaacttccggaaccgttgggaacggccgggggtcgttcggggaccgaaacggggccggacaagttaggngntgngng

SEQ ID NO: 398868 - DNA, 586 bp, Homo sapiens
  misc_feature: GZ8MTXP01EA59Z.38.2.A02.1.454.CMB.2.raw
  modified_base (388)..(388): a, c, t, g, unknown or other
  modified_base (575)..(575): a, c, t, g, unknown or other
  modified_base (579)..(579): a, c, t, g, unknown or other
  modified_base (581)..(583): a, c, t, g, unknown or other
  modified_base (585)..(586): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtaccaaagaaccagttcctccctgaagtttgacctctgtcgaccgccgcagacacggccgtatattactgtgcgagagaataaagtgttattactacaattcgttacctattactttgactacgtcggggccagggaaccctggtcaacccgtctccncacgccctacccaacgaacggggccccagtccggttccttcccccgtcggccctacccctccctacccgaagacgccacccgtcgtcgggggaccacgacggggccggcccgtgggcctcgcccgtggtacaacggtcttacctccgacgtgaactcgacgtggaggcgggcttcgggcacggcganaagngnnngnn

SEQ ID NO: 398869 - DNA, 575 bp, Homo sapiens
  misc_feature: GZ8MTXP01EQSFU.38.2.A02.1.454.CMB.2.raw
  modified_base (568)..(568): a, c, t, g, unknown or other
  modified_base (570)..(572): a, c, t, g, unknown or other
  modified_base (574)..(575): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtaccaaagaaccagttctccctgaagttgacctctgtcgaccgccgcagacacggcctatatactgtgcgagagataaagtgttaattacacaatcgttcctattacttgactacgtcggggccagggaccctggtccaaccgtctcctcacgccctaccaaccgaacgggccctagtccgtccttccccgtcggccacccctcctaccaacgtacgccaccgtcgtcggggccacgacggggccgcccgtcgggcctcggcccgtggtacaacggacctaccttccgacgtgaactcgacgtggacggcgggcttcgggcgaacgggccgagaagngnnngnn

SEQ ID NO: 398870 - DNA, 357 bp, Homo sapiens
  misc_feature: GZ8MTXP01BT76F.38.2.A02.1.454.CMB.2.raw
  modified_base (353)..(357): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtcttccccctggcaccctctccaagagcacctctgggggcacagcggccctgggctgcctggtcaaggactacttccacgtgatcgactgagcggctggcaaggcgcatagnnnnn

SEQ ID NO: 398871 - DNA, 624 bp, Homo sapiens
  misc_feature: GZ8MTXP01CL8UF.38.2.A02.1.454.CMB.2.raw
  modified_base (615)..(615): a, c, t, g, unknown or other
  modified_base (617)..(617): a, c, t, g, unknown or other
  modified_base (619)..(620): a, c, t, g, unknown or other
  modified_base (622)..(622): a, c, t, g, unknown or other
  modified_base (624)..(624): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtccctcaagagtcgagtcaccatatcactagacatgtaccaaagaaccagttctccctgaagttgacctctgtgacccgcgcagacacggccgtatattactgtgcgagagataaagtgttatactacaatcgtccctattacttgactacgtcggggccagggaccctggtcaaccgtcctccgtcacgccctccgaccgaacggggccccagtccggtcccttccccccgtcggccctacccctccctacccaaacgacgtccaacccgtcgtcgggggaccaccgacgggggccccgggtcccgtcggggccgtcggtccccgtcgggtaccgtaaacgggtcctaaccgttccgaaccgtgtaacgtcggttaccgtggacggccggggcgttcgggcgaacgggcgacctaagngngnngngn

SEQ ID NO: 398872 - DNA, 591 bp, Homo sapiens
  misc_feature: GZ8MTXP01ADJLA.38.2.A02.1.454.CMB.2.raw
  modified_base (298)..(298): a, c, t, g, unknown or other
  modified_base (307)..(307): a, c, t, g, unknown or other
  modified_base (378)..(378): a, c, t, g, unknown or other
  modified_base (419)..(419): a, c, t, g, unknown or other
  modified_base (586)..(589): a, c, t, g, unknown or other
  modified_base (591)..(591): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtaccaaagaaccagttcctccctgaagttgacctctgtcgaccgccgcagacacggccgtatattacngtgcgaganataagtgttatacacatgttcctatacttgactacgcggggccagggacccctggtcaacccgtctccctnacgcctacccgacgaagggccccagtccggtccttcccccncggcccacccctccctaccgaacgacgcccaccgtcgtcgggggccacgacggggccggcccgtgggcctcggcccgtggtaccgaacggtaccttaccgttcccgaacgttgaacttccggacgtcggacgggccgggacgttcgggcgaacgggcgacaagtagnnnngn

SEQ ID NO: 398873 - DNA, 534 bp, Homo sapiens
  misc_feature: GZ8MTXP01CMCAN.38.2.A02.1.454.CMB.2.raw
  modified_base (380)..(380): a, c, t, g, unknown or other
  modified_base (417)..(417): a, c, t, g, unknown or other
  modified_base (528)..(528): a, c, t, g, unknown or other
  modified_base (530)..(532): a, c, t, g, unknown or other
  modified_base (534)..(534): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggaggggctggagtggatcgggagtatctatcatactgggagcacctactacaacccgtccctcaagagtcgagtcaccatatcactagacatgtaccaaagaaccagttctccctgaagttgacctctgtcgaccgccgcagacacggcctatattactgtgcgagagaataagtgttatactacaattcgtcctatacttgactacgtcggggccagggaccctggccaacccgtctccncacgccctccacaacgggcccatcgtctcccctgccncctcctcacgagcacctcgtcgggcacgacgggccggccgtcggctcgccgtggcaacgctactccacgtgaactcgacgtgacggcgggcgttggcgaacggcgacaagngnnngn

SEQ ID NO: 398874 - DNA, 598 bp, Homo sapiens
  misc_feature: GZ8MTXP01C6ZRF.38.2.A02.1.454.CMB.2.raw
  modified_base (205)..(205): a, c, t, g, unknown or other
  modified_base (297)..(297): a, c, t, g, unknown or other
  modified_base (594)..(598): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagngtcgagtcaccatatcactagacatgtccaaagaaccagttcctccctgaagttgacctctgtcgaccgccgcagacacggcctatattacngtgcgagagataaagtgttatactacaattcgtccctatactttgactacgtcggggccaggggaccctggtccaacccgtctccctcacgtccctaccaccgaacgggccccagtccggtccttccccctcggccacccctccctaccaaacgacgccaccgtccgtcgggggacaccgacggggcccggcccgtcgggccgtcggccgtcggtaccgaaacgggtaccttaccttcccgacgttgaactcgacgtcggacggccggggcgttgggcgaacgggcgacgaagtagnnnnn

SEQ ID NO: 398875 - DNA, 608 bp, Homo sapiens
  misc_feature: GZ8MTXP01A2EY3.38.2.A02.1.454.CMB.2.raw
  modified_base (181)..(181): a, c, t, g, unknown or other
  modified_base (295)..(295): a, c, t, g, unknown or other
  modified_base (602)..(604): a, c, t, g, unknown or other
  modified_base (606)..(606): a, c, t, g, unknown or other
  modified_base (608)..(608): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctgggagtggatcgggagtatctatcatactgggancacctactacaacccgtcctcaagagtcgagtcaccatatcactagacatgtaccaaagaaccagttctccctgaagttcgacctctgtgaccgcgcagacacggctatatacngtgcgagagataagtgttatactacatcgttcctatactttgactacgtcggggccagggaccctggtccaaccgttctcctcacgccctccgaaccgaacggggcccctacgtccggtcccttcccccgtcggccctacccctccctacccgaaacgacgccacccgttcgcgggggccaaccgcggggcccgggccccggttcgggccgtcggtcccgtcggtaccgaaacgggtaccttaccgttcccgaccggtgtaacgtcggaccgtggacggcggggcttcgggcgacgggcgcaagagnnngngn

SEQ ID NO: 398876 - DNA, 541 bp, Homo sapiens
  misc_feature: GZ8MTXP01C4VTC.38.2.A02.1.454.CMB.2.raw
  modified_base (533)..(533): a, c, t, g, unknown or other
  modified_base (537)..(541): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttctccctgaagttgacctctgtgaccgcgcagacacgggctatattactgtgcgagagataaagtgttatactacaatgtcctatactttgactacgtcggggccagggaccctggtcaacccgtctccctcacgcctccaccaagggcccatccgtccttcccctcggccaccctcctaccaacgacgccaccgtcgtcgggggccaccgacgggccggccccgtgggctcgcccgtggtccaaggctaccttccacgtgaatcgatgagcgggcttggcaggcgcntagnnnnn

SEQ ID NO: 398877 - DNA, 356 bp, Homo sapiens
  misc_feature: GZ8MTXP01CXKD2.38.2.A02.1.454.CMB.2.raw
  modified_base (266)..(266): a, c, t, g, unknown or other
  modified_base (291)..(291): a, c, t, g, unknown or other
  modified_base (351)..(356): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtctcccctggcaccctcctccaagngcacctctgggggcacagcggcccngggctgcctggtcaaggctacttccagtgatcgactgagcgggctggcaaggcgcatagnnnnnn

SEQ ID NO: 398878 - DNA, 619 bp, Homo sapiens
  misc_feature: GZ8MTXP01AZ7YZ.38.2.A02.1.454.CMB.2.raw
  modified_base (381)..(381): a, c, t, g, unknown or other
  modified_base (609)..(609): a, c, t, g, unknown or other
  modified_base (611)..(611): a, c, t, g, unknown or other
  modified_base (613)..(614): a, c, t, g, unknown or other
  modified_base (616)..(616): a, c, t, g, unknown or other
  modified_base (618)..(618): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtaccaaagaaccagttctccctgtaagttcgacctctgtcgacccgccgcagacacggcctatattactgtgcgagagataaagtgttaattactactaattcgttcctattacttgactacgtcggggccaggacctgtccaccgtctcncacgccctaccaccgacggcccagtcccgtcctccccgcgcccacccgtctaccgacgtcgcctaccgtcggcggggaccaaccggcggggccccgggtccgtcgggccgtcgtccccgtcgggtaccgtaaacggtcccttaaccgtcccgtaaccggttggaacgttccggaaccggtcgggaccgggtcggggtccgttacgggacggaacggtccgagtaacgngngnngngng

SEQ ID NO: 398879 - DNA, 599 bp, Homo sapiens
  misc_feature: GZ8MTXP01C9OL3.38.2.A02.1.454.CMB.2.raw
  modified_base (574)..(574): a, c, t, g, unknown or other
  modified_base (592)..(592): a, c, t, g, unknown or other
  modified_base (594)..(597): a, c, t, g, unknown or other
  modified_base (599)..(599): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttctccctagaagttgacctctgtcgacccgcgcagacacggcctatatactgtgcgagagataaagtggtttaattactacctaattcgttccctattactttgacttacgtcggggacccaggggaaccctggtcccaacccgtctccctcacgccctaccaccgaacggggcccctagtccggtccttcccccgtcggccacccctccctacccaaacgcgccaccgtcgtcgggggaccacgacggggcccggtccccgtggggcctcgccgtcggtacaacggtacctaccgttccgaccgtgaactcgacgtgacggcgggtcncggcgacgggcacgaagngnnnngn

SEQ ID NO: 398880 - DNA, 340 bp, Homo sapiens
  misc_feature: GZ8MTXP01BZ6LM.38.2.A02.1.454.CMB.2.raw
  modified_base (256)..(256): a, c, t, g, unknown or other
  modified_base (264)..(264): a, c, t, g, unknown or other
  modified_base (278)..(278): a, c, t, g, unknown or other
  modified_base (333)..(333): a, c, t, g, unknown or other
  modified_base (336)..(340): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactacaatgttcctactactttgactactggggcagggaacctggtcaccgtctcctcagcctccacaaggccatcggtcttcccctgcacctctcaagngcacctgnggggcacagcgccnggctgcctgtcaaggctacttcacgtgatcgactgagcgggctggcaaggcgcanagnnnnn

SEQ ID NO: 398881 - DNA, 361 bp, Homo sapiens
  misc_feature: GZ8MTXP01ARUT3.38.2.A02.1.454.CMB.2.raw
  modified_base (353)..(361): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtcttcccctgcaccctcctccaagagcacctctgggggcacagcggccctgggctgcctggtcaaggctacttccacgtgatcgactgagcgggctggcaaggcgcagtagnnnnnnnnn

SEQ ID NO: 398882 - DNA, 661 bp, Homo sapiens
  misc_feature: GZ8MTXP01DF306.38.2.A02.1.454.CMB.2.raw
  modified_base (204)..(204): a, c, t, g, unknown or other
  modified_base (478)..(478): a, c, t, g, unknown or other
  modified_base (653)..(653): a, c, t, g, unknown or other
  modified_base (655)..(656): a, c, t, g, unknown or other
  modified_base (658)..(658): a, c, t, g, unknown or other
  modified_base (660)..(660): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagngtcgagtcaccatatcatagacatgtaccaaagaaccagttcctccctagaagttcgacctctgtgacccgcgcagacacggccgtatattactgtgcgagagataaagtgttaatactactaattcgtccctatacttgactacgtcggggccacggggaaccctggtccaacccggttcctccgtcaacgtcccctaccgaacccgaacggggtccccacgttcccggttcccttccccccgtcggcccaccccttcccaaccgaaacgacncccgtacccgttcggtcgggggacccaaccgacggggccccgggtccccgtggggtccctcggcccgttgggtaccgtaaacgggacccctttaaccgttcccgacggtcgtaacgttcggacgtcgggacggtcccggggcgttacggggcccaaagggggcccaagtaagcgngnngngng

SEQ ID NO: 398883 - DNA, 364 bp, Homo sapiens
  misc_feature: GZ8MTXP01EPQC8.38.2.A02.1.454.CMB.2.raw
  modified_base (342)..(342): a, c, t, g, unknown or other
  modified_base (357)..(357): a, c, t, g, unknown or other
  modified_base (359)..(364): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccaggggaaccctggtcaccgtctcctcagcctccaccaagggcccatcggtcttcccctggccaccctcctcaagagcacctcgtgggggcacagccggccctgggctgcctggtcaaaggactactccacgtgatcgactgagcgggcnggcaaggcgcatagncnnnnnn

SEQ ID NO: 398884 - DNA, 693 bp, Homo sapiens
  misc_feature: GZ8MTXP01A40J3.38.2.A02.1.454.CMB.2.raw
  modified_base (279)..(279): a, c, t, g, unknown or other
  modified_base (299)..(299): a, c, t, g, unknown or other
  modified_base (684)..(684): a, c, t, g, unknown or other
  modified_base (686)..(686): a, c, t, g, unknown or other
  modified_base (688)..(689): a, c, t, g, unknown or other
  modified_base (691)..(691): a, c, t, g, unknown or other
  modified_base (693)..(693): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgaggggagggggctggggtggatcgggagtatctatcatactgggagcacctactacaacccgtcctcaagagtcgagtcaccatatcactagacatgtaccaaagaaccagttctccctgaagttgacctctgtcgaccgccncagacacggcctatattacngtgcgagagataaagtgttaatactactaatcgttccctattacttgactacgtcggggccccacgggacctggtcctaccgtcctccctcacgtcccctcccgaacccgaacggggccccctaacgttcccggttcccctttccccccgtcggaccccacccccttcccctacccgaaacgacgcccacccgttccggacgggggacccaaccgaccgggccccgggggtccccggttcggggcccttccgggtcccgttcgggtacccgaaacgggtaaccccttacccgttaccccgtaaccggtcgtaaccgttccggaacgttcgggaaccgggccggggccggtcgggaccccggaaagggcccggaacctaaaggtgngngnngngn

SEQ ID NO: 398885 - DNA, 340 bp, Homo sapiens
  misc_feature: GZ8MTXP01ECX1F.38.2.A02.1.454.CMB.2.raw
  modified_base (254)..(254): a, c, t, g, unknown or other
  modified_base (258)..(258): a, c, t, g, unknown or other
  modified_base (263)..(263): a, c, t, g, unknown or other
  modified_base (276)..(276): a, c, t, g, unknown or other
  modified_base (334)..(340): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccacaaggccatcgtctcccctgcacctccncagncactngggcacagcgccnggctgcctgtcaagctactccacgtgatcgactgagcgggctggcaaggcgacatagnnnnnnn

SEQ ID NO: 398886 - DNA, 644 bp, Homo sapiens
  misc_feature: GZ8MTXP01CFT7U.38.2.A02.1.454.CMB.2.raw
  modified_base (208)..(208): a, c, t, g, unknown or other
  modified_base (298)..(298): a, c, t, g, unknown or other
  modified_base (636)..(636): a, c, t, g, unknown or other
  modified_base (638)..(638): a, c, t, g, unknown or other
  modified_base (640)..(641): a, c, t, g, unknown or other
  modified_base (643)..(644): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggagggggctggagtggatcgggagtatctatcatacgtgggagcacctactacaacccgtccctcaagngtcgagtcaccatatcactagacatgtccaaagaaccagttcctccctgaagttgacctctgtgacccgcgcagacacggcctatatacngtgcgagagataaaggtgttatactaccaattcgttccctatactttgactacgtcgggggccagggaacccctggtacccaacccgttctccctcaacgcccctaccgaacccgaacggggccccctaagtcccggttccctttccccccgtgggcccctaaccccctcccgttacccgaaacggaccgccaacccgttcggtcgggggccaaccgacggggcccgggccccgtggggcctcggcccgtgggtaccgaaagggtccttaaccgtccaccgttggaacttccggaacgtggacggccggggtcgttcgggcgaacggggcacgtaagngngnngnn

SEQ ID NO: 398887 - DNA, 581 bp, Homo sapiens
  misc_feature: GZ8MTXP01EMNX3.38.2.A02.1.454.CMB.2.raw
  modified_base (180)..(180): a, c, t, g, unknown or other
  modified_base (296)..(296): a, c, t, g, unknown or other
  modified_base (577)..(581): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggaggggctggagtggatcgggagtatctatcatactgggancacctactacaacccgtcctcaagagtcgagtcaccatatcactagacatgtaccaaagaaccagttctccctgaagttgacctctgtcgacccgcgcagacacggctatattacngtgcgagagataaagtgttaattactacaattcgttaccctattacttgactacgtcggggaccagggaccctggtccaacccgtctccctcacgccctccaaccgaacggggcccctagtcccggttcccttcccccgtcggccctacccctccctacccaacgacgccaccgtcgtcggggcacgacggccggcccgtgggcctcgcccgtggaccaacggtcctacgtcccacggtgaacgtcgcgtcggaggcggcgttcggcgaggcgacaagtgnnnnn

SEQ ID NO: 398888 - DNA, 351 bp, Homo sapiens
  misc_feature: GZ8MTXP01AJ7OW.38.2.A02.1.454.CMB.2.raw
  modified_base (265)..(265): a, c, t, g, unknown or other
  modified_base (280)..(280): a, c, t, g, unknown or other
  modified_base (342)..(351): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaaggccatcgtctcccctgcacctctcagagcacctnggggcacagcggccngggctgcctgtcaaggctacttccacgtgatcgactggagcgggctgggcaaggcgcatagnnnnnnnnnn

SEQ ID NO: 398889 - DNA, 555 bp, Homo sapiens
  misc_feature: GZ8MTXP01BISZK.38.2.A02.1.454.CMB.2.raw
  modified_base (304)..(304): a, c, t, g, unknown or other
  modified_base (311)..(311): a, c, t, g, unknown or other
  modified_base (377)..(377): a, c, t, g, unknown or other
  modified_base (387)..(387): a, c, t, g, unknown or other
  modified_base (549)..(549): a, c, t, g, unknown or other
  modified_base (551)..(553): a, c, t, g, unknown or other
  modified_base (555)..(555): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgaggggagggggctgggagtggatcggggagtatctatcatacgtgggagcacctactacaacccgtcctcaagagtcgagtcaccatatcactagacatgtaccaaagaacctagttctccctgaagttgacctctgtcgaccgccgcacgacacggctatatactgngcgaganataaagtgttatactacaatgttcctatacttgactacgtcgggccaggaccctggccaaccgtcnctcacgcccnccacgacggcccatccgtcctcccgcgccacctccacacgcgccactcgcgggcacgacgggccgccgtggccgtcgccgtcggtacgaacggtacttaccgtccctacggtgtcgtccgacgtcggacggccgggcgttcgggcgaagggccgacaagagngnnngn

SEQ ID NO: 398890 - DNA, 638 bp, Homo sapiens
  misc_feature: GZ8MTXP01CBXEJ.38.2.A02.1.454.CMB.2.raw
  modified_base (181)..(181): a, c, t, g, unknown or other
  modified_base (632)..(634): a, c, t, g, unknown or other
  modified_base (636)..(636): a, c, t, g, unknown or other
  modified_base (638)..(638): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgaggggaggggctggagtggatcgggagtatctatcatactgggancacctactacaacccgtccctcaagagtcgagtcaccatatcactagacatgtaccaaagaaccagttcctcctgaagtttcgacctctgtcgacccgccgcagaccacggccgtatattactgtgcgaagagaattaaaggtggtttaattacctaccaatttcgttccctacttactttgactacgtcggggacccagggacccctggtaccaacccgttctcctcacgcccctaccgaacccgaacggggccccctatcccggttcccttcccccgtcggtcccctaacccctccctacccgaacgacgaccgtacccgtccgtcgggggaccaccgacgggggcccggccgtcgggccgtcgccgtcgggtacgacggtacctaccgttccgaacgtgaacgtcgacgtcggacggccgggtcgttcgggcgacgggcgcgaatagnnngngn

SEQ ID NO: 398891 - DNA, 353 bp, Homo sapiens
  misc_feature: GZ8MTXP01BJOPO.38.2.A02.1.454.CMB.2.raw
  modified_base (256)..(256): a, c, t, g, unknown or other
  modified_base (265)..(265): a, c, t, g, unknown or other
  modified_base (344)..(353): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccacaaggccatcgtctccctgcacctctcagngcacctcgnggggcacagcggccctgggctgcctggtcaaggactacttccagtgatcgactgaggcgggctgggcaaggcgcatagnnnnnnnnnn

SEQ ID NO: 398892 - DNA, 597 bp, Homo sapiens
  misc_feature: GZ8MTXP01CURAL.38.2.A02.1.454.CMB.2.raw
  modified_base (181)..(181): a, c, t, g, unknown or other
  modified_base (478)..(478): a, c, t, g, unknown or other
  modified_base (591)..(593): a, c, t, g, unknown or other
  modified_base (595)..(595): a, c, t, g, unknown or other
  modified_base (597)..(597): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggagggggctggagtggatcgggagtatctatcatactgggancacctactacaacccgtccctcaagagtcgagtcaccatatcactagacatgtaccaaagaacctagttctccctagaagttgacctctgtcgaccgccgcagacacggcctatattactgtgcgagagtaataaagttggttaacttaactaccaaatttcgttaccctattactttgacttacgtcggggaccacgggaaccctggtaccaacccgttctcccgtcaccgccctacccaaccgacgggcccctagtccgtccttccccgtcgcctacccctacccactaacgacnccaccgttcgcggggccacgacgggccgccgtcggctcgccgtggcaacgtctaccttccgacgtgaacgtcgacgtgacggtcgggcgttcggcgaacggcgacgaataggnnngngn

SEQ ID NO: 398893 - DNA, 639 bp, Homo sapiens
  misc_feature: GZ8MTXP01EUIU4.38.2.A02.1.454.CMB.2.raw
  modified_base (270)..(270): a, c, t, g, unknown or other
  modified_base (588)..(588): a, c, t, g, unknown or other
  modified_base (631)..(631): a, c, t, g, unknown or other
  modified_base (633)..(636): a, c, t, g, unknown or other
  modified_base (638)..(639): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggaggggctggagtggatcgggagtatctatcatactgggagcacctactaccaaccccgtcctcaagagtcgagtcaccatatcactagacatgtaccaaagaaccagttcctccctagaacgttgacctntgtcgacccgccgacagaccacggtaccttatacttacgtggtgacgaagaagtaagttaaaaggttgtttaattaacctacctaaatttccgtttacccctaatttactttgaaccttcgtcgggggcccaagggtaacccctggtcccaaaccgtctccttcacgccctaccaaccgtaacgggcccctacgtcccgtccctccccgtcggcccaccctccctaccgacgacgccaccgtcggtcggggacaccgacggggccggcccggtcggtcgtcgcccgtcggtaccgtaacgtaccttacctccgtacgngtaacgtcgttacgtcggacggccggcgttcggcggacgcgangnnnngnn

SEQ ID NO: 398894 - DNA, 562 bp, Homo sapiens
  misc_feature: GZ8MTXP01B7R8Y.38.2.A02.1.454.CMB.2.raw
  modified_base (298)..(298): a, c, t, g, unknown or other
  modified_base (369)..(369): a, c, t, g, unknown or other
  modified_base (535)..(535): a, c, t, g, unknown or other
  modified_base (548)..(548): a, c, t, g, unknown or other
  modified_base (554)..(554): a, c, t, g, unknown or other
  modified_base (556)..(558): a, c, t, g, unknown or other
  modified_base (560)..(560): a, c, t, g, unknown or other
  modified_base (562)..(562): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaccagttcctccctgaagttgacctctgtcgaccgcgcagacacggcctatattactgtgngagagataagtgttatacacatcgtcctatacttgactacgtcggggccagggaccctggtccaaccgtcncctcgacgccctcaccgacgggcccagtccgtccttcccccgtggccaccctccctaccaagacgccaccgtcgtcggggaccacgacggggcccggcccgtcgggcgtcgccgtggtacgaacggtaccttacctccgacgtgaactcgacctggacggccgggngttcggcgaggcncgtaangnnngngn

SEQ ID NO: 398895 - DNA, 601 bp, Homo sapiens
  misc_feature: GZ8MTXP01BBQY5.38.2.A02.1.454.CMB.2.raw
  modified_base (595)..(595): a, c, t, g, unknown or other
  modified_base (597)..(598): a, c, t, g, unknown or other
  modified_base (600)..(601): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggagggggctggagtggatcgggagtatctatcatactgggagcacctactacaacccgtccctcaagagtcgagtcaccatatcactagacatgtccaaagaaccagttcctccctgaagttgacctctgtgaccgccgcagacacggccgtatacttacgtgtgcgagagataaagtgttattactaccaatgttcctattactttgactacgtcggggccaaggggtaaccctggtccaacccgttctccctcacgccctccaccgaacggggcccctagtccgttcccttccccctcggcccaccccgtccctacccgaaacgacgccaccgtcgtcgggggcacgacggggccggtcccggtcgggcgttcggcccgtggtaccgaacgggacctaccgttccacgttgaactcgacgtcggagccgggcgttcggcgagggcgcgaatagngnngnn

SEQ ID NO: 398896 - DNA, 370 bp, Homo sapiens
  misc_feature: GZ8MTXP01B6HNV.38.2.A02.1.454.CMB.2.raw
  modified_base (267)..(267): a, c, t, g, unknown or other
  modified_base (293)..(293): a, c, t, g, unknown or other
  modified_base (360)..(370): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactacttttgactactggggccagggaaccctggtcaccgtctcctcagcctccaccaagggcccatcggtcttcccctgcaccctcctccaagngcacctcgtgggggcacagcggcccngggctgcctggtcaaggactacttccacgtgactcgactggagcgggctgggcgaaggcgcatagcnnnnnnnnnnn

SEQ ID NO: 398897 - DNA, 338 bp, Homo sapiens
  misc_feature: GZ8MTXP01DA27Y.38.2.A02.1.454.CMB.2.raw
  modified_base (250)..(250): a, c, t, g, unknown or other
  modified_base (253)..(253): a, c, t, g, unknown or other
  modified_base (260)..(260): a, c, t, g, unknown or other
  modified_base (299)..(299): a, c, t, g, unknown or other
  modified_base (324)..(324): a, c, t, g, unknown or other
  modified_base (329)..(338): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttcctactactttgactactggggccagggaaccctggtcatcgtctcctcagcctcaccaggccatcgtctccctgcacctcncangcactgnggggcacagcgcctggctgctggtcaagctactccagtnatcgactggagcggctggacaggcnatagnnnnnnnnnn

SEQ ID NO: 398898 - DNA, 516 bp, Homo sapiens
  misc_feature: GZ8MTXP01DM6HX.38.2.A02.1.454.CMB.2.raw
  modified_base (381)..(381): a, c, t, g, unknown or other
  modified_base (408)..(408): a, c, t, g, unknown or other
  modified_base (417)..(417): a, c, t, g, unknown or other
  modified_base (423)..(423): a, c, t, g, unknown or other
  modified_base (427)..(427): a, c, t, g, unknown or other
  modified_base (437)..(437): a, c, t, g, unknown or other
  modified_base (470)..(470): a, c, t, g, unknown or other
  modified_base (474)..(474): a, c, t, g, unknown or other
  modified_base (485)..(485): a, c, t, g, unknown or other
  modified_base (492)..(492): a, c, t, g, unknown or other
  modified_base (507)..(507): a, c, t, g, unknown or other
  modified_base (512)..(516): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccaggggagggggctggagtggatcgggagtatctatcatactgggagcacctactacaacccgtcctcaagagtcgagtcaaccatatcaactagacatgtaccaaagaaccagttcctcctgaagttgacctctgtgaccgccgcagacacggccgtatattactgtgcgagagataaaagtgttaattactacaatgttccctatactttgactactcggggacaggaccctgccaacgtctccncagcctcaccaggccatcgtctccccngcacctccncaagcncacncgtgggcacncggcgcgtcggctgccgtgcaaggctacttccncgtnaatcgacgtgnggcggtnacggcgaaggccganaatgnnnnn

SEQ ID NO: 398899 - DNA, 533 bp, Homo sapiens
  misc_feature: GZ8MTXP02FZVTR.38.2.A02.1.454.CMB.2.raw
  modified_base (374)..(374): a, c, t, g, unknown or other
  modified_base (447)..(447): a, c, t, g, unknown or other
  modified_base (529)..(533): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggcgtggagtggagtcgggagtatctatcatactgggagcacctactacaacccgtcctcaagagtcgagtcaccatatcactagacatgtccaaagaaccagttctccctgaagttgacctctgtgaccgccgcagacacggccgtatattactgtgcgagagataaagtggttatacacaatgttccctatacttgactactggggccagggaccctggtcacccgttcncctcagcctcccaccaagggccccatccggtccttccccctggcccaccctccctccaacgacgccacctcgngggggccacgacggccggccctggggcctcggcctggtccaaggctacttccagtgactcgactgagcggctgcgagcgcannnnn

SEQ ID NO: 398900 - DNA, 656 bp, Homo sapiens
  misc_feature: GZ8MTXP02HZADC.38.2.A02.1.454.CMB.2.raw
  modified_base (651)..(651): a, c, t, g, unknown or other
  modified_base (653)..(653): a, c, t, g, unknown or other
  modified_base (655)..(655): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtaccaagaaccagttctccctgaagttgacctctgtgaccgccgcagacacggccgtatattactgtgcgagagataaaggtggttaattactaaccaattcgtttacccacttactttgacttacgtcggggacctaggtaacccctggtccacccggtcttccctcacgccccttacccaacccaaacgggggcccccaagtccgggtcccttcccccgttcggcccacccctcccttacccaacgacgaccacccgtcgtcgggggccaccgacggcccgggtccccgtcggggccgtcggcccgtcgggtaccgaaacgggtacctaaccgtttcccaaaccgttcggacgtaccggtaaccggtacggacgggccgggtccggtacggaccgaacgggccgacgtacgtacgagcncncng

SEQ ID NO: 398901 - DNA, 527 bp, Homo sapiens
  misc_feature: GZ8MTXP02I61R8.38.2.A02.1.454.CMB.2.raw
  modified_base (297)..(297): a, c, t, g, unknown or other
  modified_base (523)..(527): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttctccctgaagttgacctctgtgacccgccgcagacacggccgtatattacngtgcgagagataaagtgttatactaccaatgttccctatactttgactactggggccaggggaacccctggtcacccgtctcctcagcctccaccaagggcccatcgtcttccccctgccaccctccctccacgacgcacctcgtggggcacgagcggccctgggctgcctggtcaaggactactccacgtgactcgactgagcggcgtggcgaaggcgcacgagnnnnn

SEQ ID NO: 398902 - DNA, 614 bp, Homo sapiens
  misc_feature: GZ8MTXP02F5KPZ.38.2.A02.1.454.CMB.2.raw
  modified_base (609)..(609): a, c, t, g, unknown or other
  modified_base (612)..(614): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtccaagaaccagttctccctgaagttgaccctctgtgaccgccgcagacacggcctatattactgtgcgagagataaagtgttatacacaatgttcctatctttgactacgtcggggccagggaaccctggtcacccgttctcctcacgccctcccaaccgaaacggggccccctagtcccggttcccttccccccgtcggccctacccctccctacccaacgacgccacccgtcgtcgggggccaccgacggccggccccgtcggggccgtcggcccgtgggtaccgaacgggtaccttaccgttacccgacgtcgtaacgtccggtaaccgtgggacggccggggccgtacgggccgaaacgggcggaccacgtagngcnnn

SEQ ID NO: 398903 - DNA, 560 bp, Homo sapiens
  misc_feature: GZ8MTXP02HP7P5.38.2.A02.1.454.CMB.2.raw
  modified_base (556)..(556): a, c, t, g, unknown or other
  modified_base (558)..(560): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgacctctgtgaccgccgcagacacggccgtatattactgtgcgagagataaagtgttatactacaatgttcctatactttgactacgtcggggccagggaccctggtcacccgttctcctcacgccctcccaaccgaacggggccccatccggtccttcccccgtcggccaccctccctaccaacgacgccaccgtcgtcgggggcacgacgccggccgtgggcctcgccgtggtcgaaggctacttccgacgtcgactcgactcgacggcgggcgtcggacgaaggcgacgagtacgncnnn

SEQ ID NO: 398904 - DNA, 513 bp, Homo sapiens
  misc_feature: GZ8MTXP02IA3N3.38.2.A02.1.454.CMB.2.raw
  modified_base (421)..(421): a, c, t, g, unknown or other
  modified_base (509)..(513): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaccagttctccctgaagttgaccctctgtgaccgccgcagacacggccgtatattactgtgcgagagataaagtggttattactaccaatgttcctatactttgactactggggccagggaccctggtcacgtctctcagcctccaccagggcccatcgtctcccctgcaccctcctccaacgngcacctctggggcacagcggccctgggctcgcctggtcaaggactactccacgtgactcgactgagcgggctggcaaggcgcagtagnnnnn

SEQ ID NO: 398905 - DNA, 609 bp, Homo sapiens
  misc_feature: GZ8MTXP02GU3EY.38.2.A02.1.454.CMB.2.raw
  modified_base (603)..(603): a, c, t, g, unknown or other
  modified_base (606)..(606): a, c, t, g, unknown or other
  modified_base (608)..(609): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtccaaagaaccagttcctccctgaagttgacctctgtgacccgccgcagacacggccgtatattactgtgcgagagataaagtggttaattacaaacatcgttccctattactttgactacgtcggggccaggggtaaccctggtccaccgttctcctcacgccctccaaccgaacggggcccctagtccggtcccttcccccgtcggcccaccctccctaccaacgacgccacccgtcgtcgggggaccacgacggccgggcccgtcggggccgtcgcccgtcggtaccgaaacgggtaccttaccgttcccgacgtcgaacttccggacgtcggacggccgggcgtacgggcgaacgggcgacacgtacgngcncnn

SEQ ID NO: 398906 - DNA, 547 bp, Homo sapiens
  misc_feature: GZ8MTXP02IIXUQ.38.2.A02.1.454.CMB.2.raw
  modified_base (413)..(413): a, c, t, g, unknown or other
  modified_base (543)..(547): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaccagttctccctgaagttgacctctgtgaccgccgcagacacggccgtatattactgtgcgagagataaagtggttattactaccaatcgttcctactactttgactacgtcgggccagggaccctggtcaccgtctcctcagcctccaccaagggtccatcgtctcccctcgcnccctccctccaacgacgccacctcgtcgggggcaccgagccggcccgtcgggccgtgcccgtggtccaagggactaccgttcccacgtcgtactcgacgtcgacgcgggcgtcggcgaaggcgcgatagnnnnn

SEQ ID NO: 398907 - DNA, 554 bp, Homo sapiens
  misc_feature: GZ8MTXP02I5HCI.38.2.A02.1.454.CMB.2.raw
  modified_base (298)..(298): a, c, t, g, unknown or other
  modified_base (550)..(554): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtcctcaagagtcgagtcaccatatcactagacatgtccaaagaaccagttcctccctgaagttgacctctgtcgaccgccgcagacacggccgtatattacngtgcgagagataaagtgttatacacaatcgttcctatactttgactacgtggggccagggaccctggtcaccgtctcctcacgccctaccaccgaagggccctagtccgtccttcccccgtcggccaccctccctaccacgacgcacctcgcggggcacgacgccggcccgtgggctcgccgtggtacgaacggtactacttccgacgtcgactcgactggaggcgggcgtcggcgaacggcgcgagtacgnnnnn

SEQ ID NO: 398908 - DNA, 632 bp, Homo sapiens
  misc_feature: GZ8MTXP02J22V2.38.2.A02.1.454.CMB.2.raw
  modified_base (180)..(180): a, c, t, g, unknown or other
  modified_base (205)..(205): a, c, t, g, unknown or other
  modified_base (270)..(270): a, c, t, g, unknown or other
  modified_base (404)..(404): a, c, t, g, unknown or other
  modified_base (626)..(626): a, c, t, g, unknown or other
  modified_base (629)..(629): a, c, t, g, unknown or other
  modified_base (631)..(632): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggaggggctggagtggatcgggagtatctatcatactgggancacctactacaacccgtcctcaagngtcgagtcaccatatcactagacatcgtaccaaagaaccctagttctccctgaagttcgaccctntgtcgacccgcgcagacacggcctatattactgtgcgaagagtataaagtggttaattactaccctaattcgttaccctacgttactttagacgtacgtccggggacctaggggaacccctggtccaccgttcncctcacgccctcaccgaacgggtccacgtccgtccttcccccgtcggtcctacccctccctaccgaacgaccgccacccgtcgtcgggggaccacgacggccgggcccgtcgggaccgttcggcctacgggtaccaaacgggtaccttaaccgttccgaacgttcggacctacggaccggtacggacggccgggcgtacggaccgtaacggcgacacgtcgngcncnn

SEQ ID NO: 398909 - DNA, 535 bp, Homo sapiens
  misc_feature: GZ8MTXP02HJJUN.38.2.A02.1.454.CMB.2.raw
  modified_base (297)..(297): a, c, t, g, unknown or other
  modified_base (346)..(346): a, c, t, g, unknown or other
  modified_base (372)..(372): a, c, t, g, unknown or other
  modified_base (531)..(535): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttctccctgaagttgacctctgtgaccgccgcagaccacggccgtatattacngtgcgagagataaagtgttatacacaatgttcctactactttgactacnggggccagggaccctggtcaccgtcncctcagccctccaccaggcccatcgtctccccctgccaccctcctccaacgcgcaccctcgtcgggggcacgacggccggcccgtgggctcgccgtggtacaaggactacgttccacgtgactcgactgacggcggcgtcggccaagggcgtcaagcgnnnnn

SEQ ID NO: 398910 - DNA, 572 bp, Homo sapiens
  misc_feature: GZ8MTXP02J3R3B.38.2.A02.1.454.CMB.2.raw
  modified_base (264)..(264): a, c, t, g, unknown or other
  modified_base (383)..(383): a, c, t, g, unknown or other
  modified_base (568)..(572): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctgggagtggatcgggagtatctatcatactgggagcacctactacaacccgtcctcaagagtcgagtcaccatatcactagacatgtccaagaccagttctccctgaagttgaccctntgtgaccgccgcagacacggccgtatattactgtgcgagagataaagtgttaatactaccaatgttccctatactttgactacgtcggggccaggggaacccctggtcaccggtctccncacgccctccaccgaacgggcccatccgtccttcccccgtcggcccacccctccctacccaagacgcaccctcgtcgggggcacgacgcgggcccgtgggcctcgcccgtggtaccaaacggcttaccgttccgaacgtgaacgtcgaccgcggcggcggcgtacggacgaaggcgacgacacgnnnnn

SEQ ID NO: 398911 - DNA, 563 bp, Homo sapiens
  misc_feature: GZ8MTXP02ISGQX.38.2.A02.1.454.CMB.2.raw
  modified_base (301)..(301): a, c, t, g, unknown or other
  modified_base (327)..(327): a, c, t, g, unknown or other
  modified_base (337)..(337): a, c, t, g, unknown or other
  modified_base (367)..(367): a, c, t, g, unknown or other
  modified_base (510)..(510): a, c, t, g, unknown or other
  modified_base (559)..(563): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggagtcgggagtatctatcatactgggagcacctactacaacccgtcctcaagagtcgagtcaccatatcactagacatgtccaaagaaccagttcctccctgaagttcgacctctgtgacccgccgcagacacggccgtatattactgngcgagagataaagtgttatacacatntcctatattnactctgggccaggaccctggtcaccgttcncctcacgccctccaccgaaggggccccatccggtcccttcccccgtcgcccaccctccctacccgaacgacgaccacccgtcgtcgggggccacgacggccggcccgtcgggctcgccgtggtacgacggtacctacgttccncgtcgtacgtcgacgtgacggcgggcgtcggcgaacggcgcgagtacgnnnnn

SEQ ID NO: 398912 - DNA, 553 bp, Homo sapiens
  misc_feature: GZ8MTXP02IZ7CT.38.2.A02.1.454.CMB.2.raw
  modified_base (297)..(297): a, c, t, g, unknown or other
  modified_base (549)..(553): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttcctccctgaagttgacctctgtgaccgccgcagacacggccgtacattacngtgcgagagataaagtgttatactacaattcgttccctactactttgactacgtcggggccagggaccctggtccacccgttctcctcacgccctccaccgaagggcccatccgtcctcccctgccaccctcctaccagcgcaccgtcgcggggcacgagccggccgtcgggctcgcccgtggtacgaacggacctaccttccgacgtgactcgactggacggcggcgtacggcgaacggcgcgacgtacgnnnnn

SEQ ID NO: 398913 - DNA, 356 bp, Homo sapiens
  misc_feature: GZ8MTXP02H2BRA.38.2.A02.1.454.CMB.2.raw
  modified_base (354)..(356): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaaggcccatcggtcttcccctggccaccctcctccaagagcacctcgtggggcacagcggccctgggctgcctggtcaaggactacttccacgtgatcgactgagcgggctggcaaggcgcatagnnn

SEQ ID NO: 398914 - DNA, 611 bp, Homo sapiens
  misc_feature: GZ8MTXP02IOSOQ.38.2.A02.1.454.CMB.2.raw
  modified_base (295)..(295): a, c, t, g, unknown or other
  modified_base (607)..(611): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgacctctgtgaccgccgcagacacggccgtatattacngtgcgagagataaagtggttattactaccaatgtttccctactactttgactacgtcggggccagggaaccctggtcaccgttctccgtcacgccctcccacccgtaaggggccccatcccggtccttccccccgtggccctacccctccctacccaacgtacgccctaaccgtccgtcgggggaccaccgacggcccgggccccgtggggcctcggcccgttggtaccgaaacgggtaccttaccgtttcccgacgtcgacgttccggactcgggacggcgggccgtggaccgaagggccgacgagtacgnnnnn

SEQ ID NO: 398915 - DNA, 543 bp, Homo sapiens
  misc_feature: GZ8MTXP02JQ55E.38.2.A02.1.454.CMB.2.raw
  modified_base (339)..(339): a, c, t, g, unknown or other
  modified_base (539)..(543): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtcctcaagagtcgagtcaccatatcactagacatgtccaagaaccagttctccctgaagttgacctctgtgacccgccgcagacacggccgtatattactgtgcgagagataaagtggttatacacaatgtccctatactttnactatcggggccagggacccctggtcaccgtctcctcacgccctccaccaaggggcccatcggtccttcccccgtggccacccctccctcccaaacgacgccacctccgtcgggggccaccgagccgggccctggggctcgcccgtggtacaacggactacttccacgtgactcgatgacggcggcgcgcgagcgcacannnnn

SEQ ID NO: 398916 - DNA, 602 bp, Homo sapiens
  misc_feature: GZ8MTXP02HMRY1.38.2.A02.1.454.CMB.2.raw
  modified_base (297)..(297): a, c, t, g, unknown or other
  modified_base (595)..(595): a, c, t, g, unknown or other
  modified_base (600)..(601): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtccctcaagagtcgagtcaccatatcactagacatgtccaagaaccagttctccctgaagttgacctctgtcgaccgccgcagacacggccgtatattacngtgcgagagataagtgttatacacatcgtacctactactttgactacgcggggaccagggaccctggtcaccgttctcctcacgccctaccaccgaacgggcccacgtccggtccttcccccgtcggcccacccctccctaccaacgacgcccaccgtcgtcgggggaccaccgacggcccggtcccgtgggcctcgcccgtgggtaccaacgggtacctaccgttacccgaacgttcgaacgtccgacgtcggacggccggggccgtgggaccgaaacgggccgacgaacgtacggngcgcnng

SEQ ID NO: 398917 - DNA, 564 bp, Homo sapiens
  misc_feature: GZ8MTXP02GM4HT.38.2.A02.1.454.CMB.2.raw
  modified_base (560)..(564): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgaccctctgtgaccgccgcagacacggccgtatatactgtgcgagagataaagtgttattacacaatgttcctatacttgactacgtggggccagggaccctggtccaccgtctcctcacgccctccaccgaacggggccccagtccgtccttccccctggccacccctcctcccaacgacgccaccgtcgtcgggggccaccgagccgggcccgtcgggcctggcccgtggtcgaaggacctacgttcccgacgtcgacgtcgacgtcggacggtcgggcgtacggcgaaggcgcgataggnnnnn

SEQ ID NO: 398918 - DNA, 564 bp, Homo sapiens
  misc_feature: GZ8MTXP02HU801.38.2.A02.1.454.CMB.2.raw
  modified_base (560)..(560): a, c, t, g, unknown or other
  modified_base (562)..(564): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgacctctgtgacccgccgcagacacggccgtatattactgtgcgagagataaagtgttattacacatcgttcctatactttgactactcggggccacgggaccctggtccaccgtctcctcacgccctacccaaccgaacgggccctagtccggtcccttcccccgtgcccacccctccctccaagacgccaccctcgtcgggggcacgacggccggcccgtgggcctcgccgtggtacaaacggtccttaccgtccgacgtgactcgactggacggcgggctcgggacaaggcgcagtacgncnnn

SEQ ID NO: 398919 - DNA, 358 bp, Homo sapiens
  misc_feature: GZ8MTXP02ILBTA.38.2.A02.1.454.CMB.2.raw
  modified_base (353)..(358): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaaggcccatcggtcttcccctggcaccctcctccaagagcacctctggggcacagcggccctgggctgcctggtcaaggactacttccacgtgatcgactgagcgggctgggcaaggcgcatagnnnnnn

SEQ ID NO: 398920 - DNA, 588 bp, Homo sapiens
  misc_feature: GZ8MTXP02IP2PO.38.2.A02.1.454.CMB.2.raw
  modified_base (582)..(582): a, c, t, g, unknown or other
  modified_base (585)..(585): a, c, t, g, unknown or other
  modified_base (587)..(588): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtccaagaaccagttctccctgaagttgaccctctgtcgaccgccgcagacacggccgtatattactgtgcgagagataaagtggttattacacaattcgttccctatactttgactacgtcggggccagggaccctggtcaccgtctcctcacgccctaccaaccgaacggggccccagtccgtcccttcccccgtggcccaccctccctaccaacgacgccacctcgtcggggccacgacggccggcccgtgggcctcgcccgtggtaccgaacggaccttaaccgttccaacgtcgacgtccggactcggacgggccggggactcgggacgaacgggccgacacgtacgngcncnn

SEQ ID NO: 398921 - DNA, 530 bp, Homo sapiens
  misc_feature: GZ8MTXP02IHWS1.38.2.A02.1.454.CMB.2.raw
  modified_base (296)..(296): a, c, t, g, unknown or other
  modified_base (384)..(384): a, c, t, g, unknown or other
  modified_base (422)..(422): a, c, t, g, unknown or other
  modified_base (434)..(434): a, c, t, g, unknown or other
  modified_base (436)..(436): a, c, t, g, unknown or other
  modified_base (438)..(438): a, c, t, g, unknown or other
  modified_base (441)..(441): a, c, t, g, unknown or other
  modified_base (448)..(448): a, c, t, g, unknown or other
  modified_base (464)..(464): a, c, t, g, unknown or other
  modified_base (526)..(526): a, c, t, g, unknown or other
  modified_base (528)..(530): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtccaagaaccagttctccctgaagttcgacctctgtcgaccgccgcagacacggccgtatattacngtgcgagagataaagtgtattacacaatcgttccctatactttgacttacgtcggggaccacgggaccctggtcacccgttctccctnacgccctccaaccagggcccagtccgtctcccctgccnccctcctcacgncncncgngggcacngcggccgtggctgcgngtacaggtactacttccacgtgactcggacgtgacggcgggctacggcaaggcgcagtacgncnnn

SEQ ID NO: 398922 - DNA, 576 bp, Homo sapiens
  misc_feature: GZ8MTXP02JIE0X.38.2.A02.1.454.CMB.2.raw
  modified_base (383)..(383): a, c, t, g, unknown or other
  modified_base (419)..(419): a, c, t, g, unknown or other
  modified_base (571)..(576): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgacctctgtgacccgccgcagacacggcctatatactgtgcgagagataaagtggttattacaccaatcgttccctattactttgactacgtcggggaccaggggaaccctggtacaccgtctccncacgccctaccacgacgccacgtccgtcccttcccncgaccctccctccctacgacgacgaccctaccgtcggcgggacaccggcggtccccggccgtcggcgtccgcggtacggacgtaacggtccttaccgtaccgagtacgtacgtaccgtagacgggcggcggtcgcggacgacggcagtacgnnnnnn

SEQ ID NO: 398923 - DNA, 588 bp, Homo sapiens
  misc_feature: GZ8MTXP02IBT5S.38.2.A02.1.454.CMB.2.raw
  modified_base (277)..(277): a, c, t, g, unknown or other
  modified_base (298)..(298): a, c, t, g, unknown or other
  modified_base (482)..(482): a, c, t, g, unknown or other
  modified_base (584)..(584): a, c, t, g, unknown or other
  modified_base (586)..(588): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctgggagtggatcggggagtatctatcatactgggagcacctactacaacccgtccctcaagagtcgagtcaccatatcactagacatgtcaagacctagttctccctgaagttgacctctgtgaccgccgnagacacggcctatatactgtncgagagataagtgtatactacatcgttccatacttgactacgtcgggaccagggaccctggtacaccgtctcctcacgccctaccgaccacgggccctagtcccgtccttacccctcggtcccaccctcctacccaacgacgaccaccgtcgtacggggccacgaccggcggcccgtgggtccncgccgtggtaccaaacgggtaccttaccgttcccgtacggtacgtacgtacgtacgtcgaacgggcgggacgtcgggaccgaacgggccgtacgacgtacgncnnn

SEQ ID NO: 398924 - DNA, 593 bp, Homo sapiens
  misc_feature: GZ8MTXP02GK4CY.38.2.A02.1.454.CMB.2.raw
  modified_base (587)..(587): a, c, t, g, unknown or other
  modified_base (590)..(590): a, c, t, g, unknown or other
  modified_base (592)..(593): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtccctcaagagtcgagtcaccatatcactagacatgtccaagaaccagttctccctgaagttgacctctgtgaccgccgcagacacggccgtatattactgtgcgagagataaagtggttattactaccaatcgttccctatactttgactacgtcggggaccagggaacccctggtcaccgtctcctcagcctcccaccgaacggggcccatccggtccttcccccgtggcccaccctccctaccaagacgcacctcgtcgggggacacgacggccggcccgtgggccgttcgcccgtgggtaccaaacgggtaccttaccgttaccacgtcgaactccggactcggacgggtccgggcgtcgggaccgaacgggccggacaacgtaggngcncnn

SEQ ID NO: 398925 - DNA, 584 bp, Homo sapiens
  misc_feature: GZ8MTXP02IAU2H.38.2.A02.1.454.CMB.2.raw
  modified_base (262)..(262): a, c, t, g, unknown or other
  modified_base (293)..(293): a, c, t, g, unknown or other
  modified_base (374)..(374): a, c, t, g, unknown or other
  modified_base (578)..(578): a, c, t, g, unknown or other
  modified_base (581)..(581): a, c, t, g, unknown or other
  modified_base (583)..(584): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgagtcaccatatcactagacatgtccaagaaccagttctccctgaagttgacctntgtcgaccgcgcagacacggctatacttacngtgcgagagataaagtgttatacacatcgttcctatacttgactagtcggggacagggaaccctggtctaccgtctccctnacgccctccgaacctacgggccctagtccgttccctcccccgtcggaccctacccctcccttaccaaacgcgacccaccctcgtacgggggcaccgacggccggcccgtcgggccgtcgccgtcggtacgaacggtacctaccgttccgacgtcgtacgtccgacgtcgacggccgggcgtcggacgacgggcgacgacgtagngcncnn

SEQ ID NO: 398926 - DNA, 356 bp, Homo sapiens
  misc_feature: GZ8MTXP02F3L37.38.2.A02.1.454.CMB.2.raw
  modified_base (348)..(348): a, c, t, g, unknown or other
  modified_base (354)..(356): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaaggcccatcggtcttcccctggccaccctcctccaagagcacctcgtggggcacagccggccctgggctgcctggtcaaggactactccacgtgatcgactgagcgggctggcaaggcncatagnnn

SEQ ID NO: 398927 - DNA, 541 bp, Homo sapiens
  misc_feature: GZ8MTXP02IGFME.38.2.A02.1.454.CMB.2.raw
  modified_base (263)..(263): a, c, t, g, unknown or other
  modified_base (275)..(275): a, c, t, g, unknown or other
  modified_base (322)..(322): a, c, t, g, unknown or other
  modified_base (422)..(422): a, c, t, g, unknown or other
  modified_base (430)..(430): a, c, t, g, unknown or other
  modified_base (537)..(537): a, c, t, g, unknown or other
  modified_base (539)..(541): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttctccctgaagttgacctntgtgaccgccgnagacacggccgtatattactgtgcgagagataagtgtatactacatnttccatacttgactacgtcggggaccagggaccctggtccaccgtctcctcagccctccaccgaaggcccatccgtctcccctgccaccctccacagacncacctcgnggggcacgacgccgcccgtgggctcgacccgtggtacgaaggtacctaccgtccgacgtgactcggaccgtggacgggcgggccgtgggaccaagggcgacagtcgncnnn

SEQ ID NO: 398928 - DNA, 608 bp, Homo sapiens
  misc_feature: GZ8MTXP02F3CZP.38.2.A02.1.454.CMB.2.raw
  modified_base (602)..(602): a, c, t, g, unknown or other
  modified_base (605)..(605): a, c, t, g, unknown or other
  modified_base (607)..(608): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaagaaccagttcctccctgaagttgacctctgtgaccgccgcagacacggcctatattactgtgcgagagataaagtgttatactacaatcgttccctatacttgactacgtcggggccagggaccctggtcaccgttctcctcacgccctacccaccgaacggggcccctagtcccggtccttccccccgtcggcccacccctccctacccaacgacgccaccctcgtcgggggccacgacggcccggcccgtcgggcctcggcccgtcggtaccgaaacgggtacctaccgttacccgtacgtacgacgtccgacgtcggacgggccggggtccgtcgggaccgaaacgggccgacgaacgtacgngcncnn

SEQ ID NO: 398929 - DNA, 599 bp, Homo sapiens
  misc_feature: GZ8MTXP02HDUMO.38.2.A02.1.454.CMB.2.raw
  modified_base (306)..(306): a, c, t, g, unknown or other
  modified_base (337)..(337): a, c, t, g, unknown or other
  modified_base (350)..(350): a, c, t, g, unknown or other
  modified_base (499)..(499): a, c, t, g, unknown or other
  modified_base (555)..(555): a, c, t, g, unknown or other
  modified_base (585)..(585): a, c, t, g, unknown or other
  modified_base (594)..(594): a, c, t, g, unknown or other
  modified_base (596)..(599): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgaggggagggggctgggagtggatcgggagtatctatcatacgtgggagcacctactacaacccgtcctacaagagtcgagtcaccatatcactagacatgtaccaaagaaccagttctccctagaagttcgacctctgtcgacccgccgacagacacggcctatattacngtgcgagagaataaagtgttaatacacaatnttacctatacttnactacgcgggaccaggacctggtcaccgtctcctcacgccctaccaaccgaacgggccctacgtccggtcccttcccccgtcgccctacccctccctaccgaaacgaccgccaaccgtccgcgggggaccacgacggcccgggtcccgngggcctcggccgtaggtaccgaaacggtacctaccttccgacgtgacgtacgtacncggacggccgggcgtcgggacgaacgggcncgaaagcgngnnnn

SEQ ID NO: 398930 - DNA, 353 bp, Homo sapiens
  misc_feature: GZ8MTXP02GW3ZW.38.2.A02.1.454.CMB.2.raw
  modified_base (262)..(262): a, c, t, g, unknown or other
  modified_base (349)..(353): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaaggcccatcggtctcccctgcaccctctccagncacctctggggcacagcggccctgggctgccctggtcaaggactacttccacgtgatcgactgagcgggctgggcaaggcgcatagnnnnn

SEQ ID NO: 398931 - DNA, 607 bp, Homo sapiens
  misc_feature: GZ8MTXP02F5LFP.38.2.A02.1.454.CMB.2.raw
  modified_base (248)..(248): a, c, t, g, unknown or other
  modified_base (600)..(600): a, c, t, g, unknown or other
  modified_base (603)..(603): a, c, t, g, unknown or other
  modified_base (605)..(606): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtaccaagaaccagttcnccctgaagttgacctctgtgaccgccgcagacacggccgtatattactgtgcgagagataaagtgttatactacaatcgttccctactactttgactacgtcggggccagggaccctggtcaccgtctcctcacgccctaccaccgaacgggccccatccggtccttcccccgtcggcctaccctccctcccaacgacgccaccgtcgtcgggggcacgacggccggcccgtcgggccgtcgtcccgtgggtaccgaaacgggtacctaccgtttacccgaacgttcggaacttaccggaccgttggaacgggcggggccgtggggaccgaaacggggccgacacgtacggngcncnng

SEQ ID NO: 398932 - DNA, 544 bp, Homo sapiens
  misc_feature: GZ8MTXP02IEOCT.38.2.A02.1.454.CMB.2.raw
  modified_base (524)..(524): a, c, t, g, unknown or other
  modified_base (537)..(537): a, c, t, g, unknown or other
  modified_base (540)..(544): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaccagttctccctgaagttgacctctgtgaccgccgcagacacggccgtatattactgtgcgagagataaagtggttattactacaattcgttccctatactttgactactggggccagggaccctggtcaccgtctccgtcagccctccaccaacgggcccatcccggttctccccctggcctacccgtcctaccacgacgccaccttcgcgggggcacgacgcggccctgggctgcccgtggtcaaggccttactccgacgtcgactcgactcgacgcgggtcncggcaaggcgcanagnnnnn

SEQ ID NO: 398933 - DNA, 582 bp, Homo sapiens
  misc_feature: GZ8MTXP02IVDLW.38.2.A02.1.454.CMB.2.raw
  modified_base (267)..(267): a, c, t, g, unknown or other
  modified_base (298)..(298): a, c, t, g, unknown or other
  modified_base (577)..(582): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccaggggaggggctggagtggatcgggagtatctatcatactgggagcacctactacaacccgtccctcaagagtcgagtcaccatatcactagacatgtccaaagaaccagttctaccctaaagttcgacctntgtgaccgccgcagacacggcctatattacngtgcgagagataaagtgttaattactacaattcgttccctatactttgactacgtggggcccagggaccctggtcaccgtctcctcacgccctaccaccgaacgggccctagttcccgtcccttccccgtcggccaccctcctaccaacgcgacaccgtcgtcggggcacgacggcccggcccgtcgggcgtcggcccgtcggtacgaacggtacttaccgttccgacgtacgacgtcgtactaggcggcgggcgtcggacgaacggcgaacgagacgnnnnnn

SEQ ID NO: 398934 - DNA, 357 bp, Homo sapiens
  misc_feature: GZ8MTXP02FY88A.38.2.A02.1.454.CMB.2.raw
  modified_base (268)..(268): a, c, t, g, unknown or other
  modified_base (353)..(357): a, c, t, g, unknown or other
tcagtcgatcacgtcacgaccggtgctcgatttagactcatctacagggagaaatggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtcttccccctggcaccctcctccaagngcacctctgggggcacagcggccctggctgcctggtcaaggactactccacgtgatcgactgagcgggctggcaaggcgcatagnnnnn

SEQ ID NO: 398935 - DNA, 569 bp, Homo sapiens
  misc_feature: GZ8MTXP02JYRD2.38.2.A02.1.454.CMB.2.raw
  modified_base (565)..(565): a, c, t, g, unknown or other
  modified_base (567)..(569): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggagggggctggagtggatcgggagtatctatcatactgggagcacctactacaacccgtcctcaagagtcgagtcaccatatcactagacatgtaccaaagaaccagttcctccctgaagttcgacctctgtcgacccgcgcagacacggccgtatattactgtgcgagagataagtgttatactacatcgttcctatacttgactacgtcggggccaggaccctggtcaccgtctcctcacgccctaccaccgaacgggccctagtcccgtacccttcccccgtcgcccacccctccctaccaacgacgccaccgtcgtcgggggcacgacggccggcccgtgggctcgccgtcggtacgaacggtactaccgttccgacgtcgacgtcgacgtcgacggcggcgtcggacgaggcgcgagtacgncnnn

SEQ ID NO: 398936 - DNA, 597 bp, Homo sapiens
  misc_feature: GZ8MTXP02FE3JJ.38.2.A02.1.454.CMB.2.raw
  modified_base (179)..(179): a, c, t, g, unknown or other
  modified_base (241)..(241): a, c, t, g, unknown or other
  modified_base (246)..(246): a, c, t, g, unknown or other
  modified_base (388)..(388): a, c, t, g, unknown or other
  modified_base (431)..(431): a, c, t, g, unknown or other
  modified_base (593)..(597): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggancacctactacaacccgtccctcaagagtcgagtcaccatatcactagacatgtcaagaaccngttcnccctgaagttgaccctctgtgacccgccgcaggaccacggccgtatacttactgtgcagagataaagtgtaattactaccaatcgttccctatacttgaccttacgtcggggccaggggaccctggtaccaccgttctcccncagcctaccaaccgaagggcccctatccggttccttcccccgngcccaccctcctacccaagtacgccaccgtcgtcgggggaccaccgaggcccggcccgtgggccgtcgcccgttggtaccgaacgggtacctaaccgttccgacgtcgactaccgtaacgtcggaggccggggctcggggacaacggggtccgacacgtagnnnnn

SEQ ID NO: 398937 - DNA, 557 bp, Homo sapiens
  misc_feature: GZ8MTXP02GUPCD.38.2.A02.1.454.CMB.2.raw
  modified_base (243)..(243): a, c, t, g, unknown or other
  modified_base (290)..(290): a, c, t, g, unknown or other
  modified_base (337)..(337): a, c, t, g, unknown or other
  modified_base (552)..(552): a, c, t, g, unknown or other
  modified_base (554)..(557): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtcctcaagagtcgatcaccatatcactagacatgccaagaccagttcnccctgaagttgaccctctgtgaccgccgcagacacggcctatatacngtgcagagataaagtgtatacacaatgttccctatacttgactacgnggggaccagggaccctggtccaccgttctccctcaacgcctacccaccgaacgggccccatccggtccttcccccgtggccacccctcctacccaaacgacgccaccctcgtcgggggccaaccgcgcccgggccctcggggctcgcctgggtacaaggactactccacgttgactcgactcggagcggggctcgggacaacgggcgcagtacgngnnnn

SEQ ID NO: 398938 - DNA, 599 bp, Homo sapiens
  misc_feature: GZ8MTXP02ISFAP.38.2.A02.1.454.CMB.2.raw
  modified_base (248)..(248): a, c, t, g, unknown or other
  modified_base (500)..(500): a, c, t, g, unknown or other
  modified_base (595)..(598): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccagggaggggctggagtggatcgggagtatctatcatactgggagcacctactacaacccgtccctcaagagtcgagtcaccatatcactagacatgtccaaagaaccagttcnccctgaagttgacctctgtgacccgccgcagaccacggccgtatattactgtgcgagagaataaagtggttaattacgtaccaatcgttaccctacgtactttcgactacgtcggggaccagggaacccctggtccaccgtctcctcagccctaccaccgaacgggcccactccggtcccttcccccgcgtccacccctccctacccgaacgacgccacccgtcgtcgggggaccaccgaggcccgggcccncggggccgtcgcccgtggtaccgaacggacctacctcccgtaacgtgaccgtcgacgtcgacggcgggactcgggaccgaggccgcgtaagcgannnng

SEQ ID NO: 398939 - DNA, 381 bp, Homo sapiens
  misc_feature: GZ8MTXP02G2ZDI.38.2.A02.1.454.CMB.2.raw
  modified_base (285)..(285): a, c, t, g, unknown or other
  modified_base (360)..(381): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccaggggaaccctggtcaccgtctcctcagcctccaccaaggcccatcggtccttcccctggccaccctcctccaagagcactcgtggggcacngcggccgtggctgctggcaaggctactccacgtgatcgactggagcgggctgggacgaagggcgacagtaaggcnnnnnnnnnnnnnnnnnnnnnn

SEQ ID NO: 398940 - DNA, 573 bp, Homo sapiens
  misc_feature: GZ8MTXP02ICWP0.38.2.A02.1.454.CMB.2.raw
  modified_base (383)..(383): a, c, t, g, unknown or other
  modified_base (385)..(385): a, c, t, g, unknown or other
  modified_base (451)..(451): a, c, t, g, unknown or other
  modified_base (568)..(573): a, c, t, g, unknown or other
tcagtcgatcacgtcacgaccggtgctcgatttagactcatctacagggtcttcggagaccctgtccctcacctgcaatgtctctggttactccatcagcagtggttactactggggctggatccggcagcccccgagggagggggctggagtggatcgggagtatctatcatactgggagcacctactacaacccgtccctcaagagtcgagtcaccatatcactagacatgtcaaagaccagttctccctgaagttcgacctctgtcgacccgccgcagaccacggccgtatacttactgtgcgagagataagtgtattacactaatcgttacctactactttgactacgcgggaccgacggacccgtgtcaccgtctccncncgccctaccaccgacgggccctacgtcccgttccctccccgtgccctacccctccctaccaacgcncccgtaccgttcgcggggacacgacggcccggtccgtcggcgtcgaccgtggtacaacggtctaccgttcgacgtcgtacgtcgtcggcgacggcggcgtcggacgacggcgacagnnnnnn

SEQ ID NO: 398941 - DNA, 360 bp, Homo sapiens
  misc_feature: GZ8MTXP02JUQ9P.38.2.A02.1.454.CMB.2.raw
  modified_base (350)..(350): a, c, t, g, unknown or other
  modified_base (356)..(360): a, c, t, g, unknown or other
tcagtcgatcacgtcacgaccggtgctcgatttagactcatctacagggagaactggttcttggacatgtccaagaaccagttctccctgaagttgacctctgtgaccgccgcagacacggccgtatattactgtgcgagagataaagtggttattactaccaatgttccctactactttgactactggggccagggaaccctggtcaccgtctcctcagcctccaccaagggcccatcggtcttccccctggccaccctcctccaagagcacctcgtgggggcacagcggccctgggctgcctggtcaaggctacttccacgtgatcgactgagcgggctggcaaggcncatagnnnnn

SEQ ID NO: 398942 - DNA, 572 bp, Homo sapiens
  misc_feature: GZ8MTXP01EQNFG.15.40.D07.1.454.CMB.2.raw
  modified_base (235)..(235): a, c, t, g, unknown or other
  modified_base (356)..(356): a, c, t, g, unknown or other
  modified_base (450)..(450): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttgggtaaagccgggggggtcccttagactctcctgtgcagcctctggattcgctttcagtgacgcctggatgacctgggtccncaggctccgagggagggctggagtgggtgcatataaagcaatgatgaaggtggacacagaccacgctccacccgtgaaaggcagattcaccatctacaagagatgaattaccaaaaaaacncgctgtcctactaccaatcgaaacaacctagaaacgaccgagacacagccgtagtatactcgtaccactgtcgggcctactactcgatggggtntctttgatatcgtgggaccaaaggggactaaagtcggtacctaccggtcctcttcacgttccttaccgaaccgaacgggcccttacgtcccggtcccttccccgtgcccgccctgccgtccg

SEQ ID NO: 398943 - DNA, 645 bp, Homo sapiens
  misc_feature: GZ8MTXP01ACEB5.15.40.D07.1.454.CMB.2.raw
  modified_base (333)..(333): a, c, t, g, unknown or other
  modified_base (355)..(355): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttggtaaaggccgggggggtcccttagactctcctgtgcagcctctggattcgctttcagtgacgcctggatgacctgggtccgcaggctcgagggagggctggagtgggtgcatataaagcatgatgagtggacacagaccacgctccaccgtagaaagcagactcaccatctacaaganatgaaattaacccaaaaaaacncgtactacgtcctaacctaacccaaattacgaaaccctaaaccgtaggaaacgacccgaggaaaccacacgccgtagtaacttacgtcgtaaccctaccgtggtcgggtaccctacgtacgtccgtagttggggtgtcgttttagaagttacgttcgtaggggacccgaaaggggtacctaagtcgggtacctaccggtctaccttcgacgttccgtacccgaaccgttaccgggccccttacgtcccgggtcccttcccccgtcggcccgttccctcgcccgtaacccg

SEQ ID NO: 398944 - DNA, 580 bp, Homo sapiens
  misc_feature: GZ8MTXP01BVXK2.15.40.D07.1.454.CMB.2.raw
  modified_base (276)..(276): a, c, t, g, unknown or other
  modified_base (337)..(337): a, c, t, g, unknown or other
  modified_base (359)..(359): a, c, t, g, unknown or other
  modified_base (484)..(484): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctggggggaggcttgggtaaaggccgggggggtcccttagactctcctgtgcagcctctggattcgctttcagtgacgcctggatgacctgggtccgcaggctccgagggagggctggagtgggtgcatataaagnaatgatgaaggtggacacagaccacgctccaccgtgaaaggcagattcacatctacaaganatagaacttaaccaaaaaaacncgactcgtcctaacctaccaatcgaaaccaaccgtagaacgaaccgaggaccacacgccgtagtacttactcgtaccaccgtggtcgggcctactactccgagtggggtctctttgattagtcgnggggacgaaggactaagtcgtcaccgtctcttcacgcctaccgacgaacggcccttacgtccggtccctccccgtcggccgttccctcgccgtccg

SEQ ID NO: 398945 - DNA, 748 bp, Homo sapiens
  misc_feature: GZ8MTXP01BL2KI.15.40.D07.1.454.CMB.2.raw
  modified_base (237)..(237): a, c, t, g, unknown or other
  modified_base (276)..(276): a, c, t, g, unknown or other
  modified_base (369)..(369): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttgggtaaaggccgggggggtccttagactctcctgtgcagcctctggattcgctttcagtgacgcctggatgaccgtgggtccnccaggctcgagggagggctggagtgggtgcatataaagnaatgatgagtggacacagaccacgctaccgaccgtagaaacggcagattccactatctacgaaagagaatagaaacttaaacccaaaaaaacncggtactacgttaccctaaccctaaacccgtaaagttacaaaacccgtaaaccgtacgaaaaccgggaacccggaagggaaacccaacgtaacggtaccgttaaggttaacttaaccgttacgtaaacccctaccgttcgggtaccggggtacccttaaccgttaccgtacccgtaaggttggggttacggtttccgttttagaacttacggtccggtacggggaacgaaaggggtaactaaggtccggtacctaccggttctctttaccgacgttcccgttaaccccgaacccggttaaccgggccccttacggttccccggttccccgttccccccgtcgggggtcccccttccccgtcggttcccctaacccgggg

SEQ ID NO: 398946 - DNA, 575 bp, Homo sapiens
  misc_feature: GZ8MTXP01BJNRN.15.40.D07.1.454.CMB.2.raw
  modified_base (235)..(235): a, c, t, g, unknown or other
  modified_base (563)..(563): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttggtaaaggccggggggtcccttagactctcctgtgcagcctctggattcgctttcagtgacgcctggatgacctgggtccnccaggctccgagggagggctggagtgggtgcatataaagcaatgatgaaggtggacacagaccacgctccaccgtgaaaggcagattcaccatctcaagagatagaacttaaccaaaaaaactcgctacgtcctaacctaccaatgaaaccaacctagaacgacgagacacagcgtagtatactgtaccacgtgtcgggacctactactacgtatggggttgttcttttgattagtcgtacggggaccgaaagggactaagttcggtcctaccgtctcttcacgttccttaccacgacggccttacgtccgtccctccccgtggcccnccgtcgcctccg

SEQ ID NO: 398947 - DNA, 641 bp, Homo sapiens
  misc_feature: GZ8MTXP01COEA9.15.40.D07.1.454.CMB.2.raw
  modified_base (283)..(283): a, c, t, g, unknown or other
  modified_base (357)..(357): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttgggtaaaggccgggggggtcccttagactctcctgtgtagcctctggattcgctttcagtgacgcctggatgacctgggtccgccaggctccgaggggagggctggagtgggtgcatataaagcaatgangaggtggacacagaccacgctccaccgtgaaacgcagattcaccatctcaagagatagattaacaaaaaaaccncgactgtctactaaccaaatcgaaacaacctgaaacgaccgaggacacagtccgtagtacttacgtacgtaacccaccgttggtacggggtaccctacgttaccgtccgtagttgggttcggttctttttaggattaacgtcgtcgggggaccgaaaggggtacaagtcgggtacctacccgttctaacttccgacgtccttcccgaaacccgtaacggggccccttacgttccccggtccccttcccccgtcggcccctcccgttcgtcccgttcccgaacgg

SEQ ID NO: 398948 - DNA, 586 bp, Homo sapiens
  misc_feature: GZ8MTXP01C0U7H.15.40.D07.1.454.CMB.2.raw
  modified_base (234)..(234): a, c, t, g, unknown or other
  modified_base (272)..(272): a, c, t, g, unknown or other
  modified_base (357)..(357): a, c, t, g, unknown or other
  modified_base (459)..(459): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccgggggggtcccttagactctcctgtgcagcctctggattcgctttcagtgacgcctggatgacctgggtccnccaggctcgagggagggctggagtggtgcatataaagnatgatgaaggtggacacagaccacgctccgacccgtagaaacggcagacttcacctatcacaagagatgaattaaccaaaaaacncgctgtcctaacaccaaatcaaaccaacctagaaacgaccgaagacacgagccgtgtatactagtaccaccgtggtcgggactactactccgagttggggtntcgtttgatagtcgtgggaccgaagggtactaagtcgtcctaccgtctcttctacttccgttaccacgaaccggttccttacgttcccggtccttcccccgtcggccgttccctcgcccgtaacccg

SEQ ID NO: 398949 - DNA, 632 bp, Homo sapiens
  misc_feature: GZ8MTXP01D9OC2.15.40.D07.1.454.CMB.2.raw
  modified_base (240)..(240): a, c, t, g, unknown or other
  modified_base (257)..(257): a, c, t, g, unknown or other
  modified_base (278)..(278): a, c, t, g, unknown or other
  modified_base (301)..(301): a, c, t, g, unknown or other
  modified_base (303)..(303): a, c, t, g, unknown or other
  modified_base (313)..(313): a, c, t, g, unknown or other
  modified_base (621)..(621): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctgggtggagtcgtggggggaggcttgggtaaaggccgggggggtcccttagactctcctgtgcagcctcgtggattcgctttcagtgacgcctggatgacctgggtccncaggctcgagggagggntggagtgggtgcatataaagnaatgatgaggtggacacagaccncnctccaccgtnaaaggcagattcactatcacaagagatgaaacttaaacccaaaaaaacgcgtactacgttaccctaaccctaaaccaaatacgaaaaccctaaaccgtaggaaaaccggaaccggaaggaaccaacgacgtaccgtagtaacttactacgtaccctacgttgggtaccgggacctaactaccgtaccgtatcgggggttctcttttagacttacgtccggtggggaaccgtaaaggtactaagttcgtacctaccgttctcttcacgttcctaccgaaccgacggcccagtccgtccctcccgtcgcncctcgcgtccg

SEQ ID NO: 398950 - DNA, 729 bp, Homo sapiens
  misc_feature: GZ8MTXP01ETO61.15.40.D07.1.454.CMB.2.raw
  modified_base (236)..(236): a, c, t, g, unknown or other
  modified_base (275)..(275): a, c, t, g, unknown or other
  modified_base (298)..(298): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttgggtaaaggccgggggggtcccttagactctcctgtgcagcctctggattcgctttcagtgacgcctggatgacctgggtccncaggctcgagggagggctggagtgggtgacatataaagnatgatgagtggacacagaccacncctccgaccgtagaaacggcagacttcacatctacaagacatagaaacttaaaccaaaaaaactcgactacgtaccctaaacctaacccaaagttacgaaaaccctaaaccgtagaaacgggaaccggaagggaaccaacgtacggtaccgttaggtaacttaccgtacgtaacccctacgttcgggtaccgggtacccttaaccgtaacctccggtaagttcgggggttacgtttaccgttttaggaacgttacgtcgggtacggggtaaccgtaaacggggaacctaaacggtcggtacccgtaacccggttcttaccgttacgtacgttaccgttaccccgaaacccggttaaaccgggttccccttaaccgttcccgggttccccttccccggtcggtccccgttcccgtcgttcccgtaacccggg

SEQ ID NO: 398951 - DNA, 629 bp, Homo sapiens
  misc_feature: GZ8MTXP01C183N.15.40.D07.1.454.CMB.2.raw
  modified_base (276)..(276): a, c, t, g, unknown or other
  modified_base (313)..(313): a, c, t, g, unknown or other
  modified_base (365)..(365): a, c, t, g, unknown or other
  modified_base (612)..(612): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcgttgggtaaaggccgggggggtcccttagactctcctgtgcagcctctggattcgctttcagtgacgcctggatgacctgggtccgcaggctcgagggagggctggagtggtgacatataaagnaatgatagaaggtggacacagaccacgctaccaccgngaaagcagactcacatacacaaagagtatagaacttaaacccaaaaaaaacncgactacgtcctaaaccaaccaaagttacgaaaaccaaaccgtagaaacgaaccgaaggaaccaacacgtacgtacgtaattacgtacgtaacctaccgtggtcgggacctacgtactaccgagttggtagtctttagatatcgtagggaccaaaggggtacaaagtcggtacctccgtaactcgttcacgccttaccgaaccgaaacggttcccttacgttcccggtacccttccccgtcggtccnccccgtgcccgtaaccg

SEQ ID NO: 398952 - DNA, 623 bp, Homo sapiens
  misc_feature: GZ8MTXP01EQMNH.15.40.D07.1.454.CMB.2.raw
  modified_base (275)..(275): a, c, t, g, unknown or other
  modified_base (277)..(277): a, c, t, g, unknown or other
  modified_base (284)..(284): a, c, t, g, unknown or other
  modified_base (292)..(292): a, c, t, g, unknown or other
  modified_base (296)..(297): a, c, t, g, unknown or other
  modified_base (313)..(313): a, c, t, g, unknown or other
  modified_base (320)..(320): a, c, t, g, unknown or other
  modified_base (324)..(324): a, c, t, g, unknown or other
  modified_base (328)..(328): a, c, t, g, unknown or other
  modified_base (345)..(345): a, c, t, g, unknown or other
  modified_base (348)..(348): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttgggtaaaggccgggggggtcccttagactctcctgtgcagcctctggattcgctttcagtgacgcctggatgacctgggtccgcaggctcgagggagggctggagtgggtgcatataaagnangatgagnggacacanaccnncaccaccgagaagcanactcacntcanaganatagaataaccaaaacnctntctactaactaacaagtacgaaacctaacgtagaaacgaccggagaccacgacgtccgtagtacttactacgttaccgccgtagggtacgggtacctacctacgtaccgtagttgggttcgttacgtttcgattcgtccgggtacggggaacccgtaaagggtactaagttcggtaccctaccgttctccttacacgttccttaccccgaacgaaccggttcccttacggttcccgtcccgttccccgtcggcccgttccctcgccgtaacccgg

SEQ ID NO: 398953 - DNA, 582 bp, Homo sapiens
  misc_feature: GZ8MTXP01EKRKP.15.40.D07.1.454.CMB.2.raw
  modified_base (275)..(275): a, c, t, g, unknown or other
  modified_base (332)..(332): a, c, t, g, unknown or other
  modified_base (350)..(350): a, c, t, g, unknown or other
  modified_base (354)..(354): a, c, t, g, unknown or other
  modified_base (458)..(458): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtggggaggcttgggtaaaggccgggggggtccttagactctcctgtgcagcctctggattcgctttcagtcgacgcctggatgacctgggtccgccaggctccgagggagggctggagtggtgcatataaagnatgatgaggtggacacagaccacgctccgaccgtagaagcagactcacatcacaganatagtactaaccaaaacngctntcctaactacaatcgaaacacgtagaacgacgacgacacacgtaccgtagtactactagtaccctacgtgtacgggtacctacgtactaccgtagttgggggtnttcgtttagacttacggtagtcggggaacgaacgggtataacgtcgtcgaccgtctcgttcacgttccctacgaacccgaacgccacggttccgtccctcccgtcgccgcccgtcgccgtccgg

SEQ ID NO: 398954 - DNA, 597 bp, Homo sapiens
  misc_feature: GZ8MTXP02G8E12.15.40.D07.1.454.CMB.2.raw
  modified_base (355)..(355): a, c, t, g, unknown or other
  modified_base (361)..(361): a, c, t, g, unknown or other
tcagtctacgtagccacgaccggtgctcgatttagtgatagagcgtaacaacagaggactcaccatggaatttgggctgagctggattttccttgctgctattttaaaggtgtccagtgtgaggtgcagctggtggagtctgggggaggcttggtaaagccggggggtcccttagactctcctgtgcagcctctggattcgctttcagtgacgcctggatgacctgggtccgccaggctccgagggaagggctggagtgggtgccatataaagcaatgatgaaggtggacaccagaccacgctccaccgtgaaaggcagattcaccatctacaagagatgaattaccaaaaaacncgactntctactacaatcgaaacaaccgagaacgaccgagaaccacacgaccgtagtaacttactacgtacctaccgtcggtacgggtaccctactaccgtaccgtagttggtgttcgtttagatagtcgtacgggaccgaaggactaagtcgtacctaccgtctacttacacgtccttacccgaccgaaccggccctacgtcccgttcccttccccgtcggcccgtcccgtcgaccgtccg

SEQ ID NO: 398955 - DNA, 536 bp, Homo sapiens
  misc_feature: GZ8MTXP02F9VOW.15.40.D07.1.454.CMB.2.raw
  modified_base (355)..(355): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctggggaggcttggtaaagccggggggtcccttagactctcctgtgcagcctctggattcgctttcagtgacgcctggatgacctgggtccgccaggctccagggaagggctggagtgggttgccatataaagcaatgatgaaggtggacaccagaccacgctccacccgtgaaaggcagattcaccatctcaaagagatgattaccaaaaaacncgctgtctctccaatgaaacaacctgaagaccgaggacacagccgtgtatactgtaccactgtggggcctactactccgatggtgtctttgatatcgtggggaccaagggacaatggtcaccgtctcttcacgtcttccaccaacggcccatcggtcctccccgtcgccgccctcgctccg

SEQ ID NO: 398956 - DNA, 545 bp, Homo sapiens
  misc_feature: GZ8MTXP02HY13I.15.40.D07.1.454.CMB.2.raw
  modified_base (233)..(233): a, c, t, g, unknown or other
  modified_base (271)..(271): a, c, t, g, unknown or other
  modified_base (348)..(348): a, c, t, g, unknown or other
  modified_base (398)..(398): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccggggggtcccttagactctcctgtgcagcctctggattcgctttcagtgacgcctggatgacctgggtccncaggctccgagggagggctggagtggtgcatataaagnatgatgaggtggacaccagaccacgctccaccgtgaaaggcagattcaccatctcaagagatgattaccaaaaaacncgctgtctactcaatgaaacactgaagaccgagacacagccgtgtatacngtaccacctgtcgggcctactactcgtatgtgtctttgatatcgtgggcctaagggacaatggtcaccggtctcttcacgtcttaccaccgtaacgggcccctacgtccggttccctttcccccgcggcccgcccgtcgtacctccg

SEQ ID NO: 398957 - DNA, 566 bp, Homo sapiens
  misc_feature: GZ8MTXP02IK42N.15.40.D07.1.454.CMB.2.raw
  modified_base (363)..(363): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccggggggtcccttagactctcctgtgcagcctctggattcgctttcagtgacgcctggatgacctgggtccgccaggctccaggggaagggctggagtgggttggccatattaaagcaatgatgaaggtggacaccagaccacgctccacccgtgaaaggcagattcaccatctacaaagagatagaattaccaaaaaaacncgctagtctactaccaatgaaacaacctagaaacgacgaagacacagccgtagtattactcgtaccacctcgtcggggcctactacctccgatggtagtctttgatatcgtgggacaagggacaagtggtcaccgtctcttcacgtcttaccaccgaacggcccacgtccggtccttcccccgtcggccgccctcgtcctccg

SEQ ID NO: 398958 - DNA, 619 bp, Homo sapiens
  misc_feature: GZ8MTXP02GCUKA.15.40.D07.1.454.CMB.2.raw
  modified_base (271)..(271): a, c, t, g, unknown or other
  modified_base (349)..(349): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccggggggtcccttagactctcctgtgcagcctctggattcgctttcagtgacgcctggatgacctgggtccgccaggctccagggagggctggagtggtgcatataaagnaatgatgaagtggacacagaccacgctccaccgtgaaaggcagattcaccatctcaagagatgattaccaaaaaaacncgactgtactacctaacaatacgaaaccaaacctagaaacgaaccggaaggaaccaacacgaccgtagtaacttactacgtaacccaccgtggtacggggaccctacctaccgtaccgagtggtcgttctttagattagtcgtacggggacgaagggactaagtcggtacgaccgttcttacttcacgtaccttacccgaacccgaaccgggacccctacgttcccggttccccttcccccgtcggtaccccgtcccgtccgtccctccg

SEQ ID NO: 398959 - DNA, 604 bp, Homo sapiens
  misc_feature: GZ8MTXP02IEHCU.15.40.D07.1.454.CMB.2.raw
  modified_base (270)..(270): a, c, t, g, unknown or other
  modified_base (272)..(272): a, c, t, g, unknown or other
  modified_base (351)..(351): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccgggggggtccttagactctcctgtgcagcctctggattcgctttcagtgacgcctggatgacctgggtccgcaggctcgagggagggctggagtggtgcatataaagnangatgaaggtggacacagaccacgctccaccgtgaaaggcagacttcaccatctacaagagatgaattaccaaaaaaacncgctgtctactacaatgaaacaacctagaacgaccgagacacacgccgtagtattactacgtacccaccgtggtcggggtacccttactaccgtaccggtacgttgggtcgttcgttttagtagttacgtcggtacgggggaccgaaaggggactaagttcggtacctaaccgttctacttcacgtacctaccgaccgaaccggtccctacgttcccgttcccttccccgtcggcccgtccctcgtccacccg

SEQ ID NO: 398960 - DNA, 586 bp, Homo sapiens
  misc_feature: GZ8MTXP02JYUIA.15.40.D07.1.454.CMB.2.raw
  modified_base (365)..(365): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccggggggtcccttagactctcctgtgcagcctctggattcgctttcagtgacgcctggatgacctgggtcccgccaggctccgaggggaaggggctggagtggggttggccatattaaaagcaatgatgaaggtggacaccagaccacgctccaccgtgaaaggcagattcaccatctcaaagagatgaattacccaaaaaacncgactgtctctccaatcgaaacaacctgaacgaccgaggacacagccgtagtacttactgtaccacctgtcggggcctactactccgatggtgtcttttgattagtcgtggggtacccgaaagggacaagtcggtacgaccgttctcttcacgtccttccaccgaacgggcccacgtcccggttcccgttcccccgtcggcccgtcccgtcgcctacccgg

SEQ ID NO: 398961 - DNA, 568 bp, Homo sapiens
  misc_feature: GZ8MTXP02FNTR3.15.40.D07.1.454.CMB.2.raw
  modified_base (236)..(236): a, c, t, g, unknown or other
  modified_base (275)..(275): a, c, t, g, unknown or other
  modified_base (357)..(357): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttgggtaaagccgggggggtcccttagactctcctgtgcagcctctggattcgctttcagtgacgcctggatgacctgggtccnccaggctcgagggagggctggagtgggtgcatataaagnaatgatgaaggtggacacagaccagctccaccgtagaaaggcagatcaccatcacaaagagatgaattaacccaaaaaaacncgctcgtactacctacaatcgaaacaacctagaaacgaccgaggacacagccgtagtacttactcgtaccaccgtgtcgggcctacgtactcgagtcggtgtctttgatatcgtgggaccgaagggacaagtgtacacgtctctcacgtccttaccaccgaccggccctacgtcccggttcccttccccgtcggcccgcccgtcgcctccg

SEQ ID NO: 398962 - DNA, 624 bp, Homo sapiens
  misc_feature: GZ8MTXP02F0PAE.15.40.D07.1.454.CMB.2.raw
  modified_base (238)..(238): a, c, t, g, unknown or other
  modified_base (282)..(282): a, c, t, g, unknown or other
  modified_base (364)..(364): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttgggtaaaggccgggggggtcccttagactctcctgtgcagcctctggattcgctttcagtgacgcctggatgaccgtgggtccnccaggctccgaggggaaggggctggagtgggttgcatataaagnaatgatgaaggtggacacagaccacgctccaccgtgaaaggcagattcaccatctacaagagatagaattaaccaaaaaacncgactagtcctactacaatcgaaacaactagaacgaaccgagacacgagccgtagtattactgtaccacgtcggtcgggcctactacgtaccgtagtggtgtctttgtattagtcggtcggggacaaggggaactagtcgggtacctaccggtcttaccgttacgacgtacccttaccgaacccgtaaaccgggcccctaacggttcccggttcccctttcccccggtcggtccccgtcccgtccgtacccgtaacccgg

SEQ ID NO: 398963 - DNA, 569 bp, Homo sapiens
  misc_feature: GZ8MTXP02GCXZK.15.40.D07.1.454.CMB.2.raw
  modified_base (323)..(323): a, c, t, g, unknown or other
  modified_base (326)..(326): a, c, t, g, unknown or other
  modified_base (331)..(331): a, c, t, g, unknown or other
  modified_base (350)..(350): a, c, t, g, unknown or other
  modified_base (424)..(424): a, c, t, g, unknown or other
  modified_base (557)..(557): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggagcttggtaaagccggggggtcccttagactctcctgtgcagcctctggattcgctttcagtgacgcctggatgaccgtgggtccgccaggctccgagggagggctggagtggtggcatataaagcaatgatgaggtggacaccagaccacgctccaccgtgaaaggcagatcacntcnaaganatagaataaccaaaaaacncgactgtactacctaccaatcgaaacaacctagaacgaacggagaccacacgccgttagtacttactcgtaccnccgtgtcgggcctacgtactccgagtggtgtctttgatatcgtgggaccaagggacagtcgtcacgttctacttcacgtccttaccaccgacggtcccctagtcccggttccccttcccgtcggcccgtcccncgtccgtacccg

SEQ ID NO: 398964 - DNA, 706 bp, Homo sapiens
  misc_feature: GZ8MTXP02JH3X1.15.40.D07.1.454.CMB.2.raw
  modified_base (277)..(278): a, c, t, g, unknown or other
  modified_base (337)..(337): a, c, t, g, unknown or other
  modified_base (343)..(343): a, c, t, g, unknown or other
  modified_base (362)..(362): a, c, t, g, unknown or other
tcagtctacgtagccacgaccggtgctcgatttagtgatagagcgtaacaacagaggaatcaccatggaatttgggctgagctggattttccttgctgctattttaaaaggtgtccagtgtgaggtgcagctggtggagtcgtggggggaggcttgggtaaaggccgggggggtcccttagactctcctgtgcagcctctggattcgctttcagtgacgcctggatgaccgtgggtccgccaggctccgagggagggctggagtggtgcatataaannaatgatgaggtggacaccgagaccacgctcccaccgtagaaacggcagattcaccatcncaaagnatagaattaccaaaaaacncgctagtctactaccaatcgaaacaacctagaaacgaaccggaaggaccacgacgccgtagtaacttactacgtacccaccgtcggtacggggaccctaacgtaccgttaccgtagttcgggttcgttcgttttaggtaattacgttaccggttagggggacccgtaaaggggaacctaaaggtaccgggtaccgttaacccggttcctttaccgttccgaaaccggttccgtttaacccccaaccgggtaaaacccggggccccctaaaccggttccccggggttacccctttcccccccggttcgggacccccgtccccggttccgtacccgtaaccccggg

SEQ ID NO: 398965 - DNA, 572 bp, Homo sapiens
  misc_feature: GZ8MTXP02GBFMH.15.40.D07.1.454.CMB.2.raw
  modified_base (272)..(272): a, c, t, g, unknown or other
  modified_base (356)..(356): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaaggccggggggtcccttagactctcctgtgcagcctctggattcgctttcagtgacgcctggatgacctgggtccgccaggctcgagggagggctggagtggtgcatataaagnaatgatgaaggtggacacagaccacgctccaccgtgaaaggcagattcaccatctacaaagagatagaattaacccaaaaaacncgactgtctactaccaatcgaaacaacctagaaacgaccgagacacagccgtagtattactgtaccaccgtagtcgggacctacgtactaccgagtggtcgtcgtttgtatagtcgtgggaccgaagggacaagtcggtactaccgtctcttcacgtcctaccgaccgaacggccctacgtccgtcccttccccgtcggcccgccctcgcctaccg

SEQ ID NO: 398966 - DNA, 554 bp, Homo sapiens
  misc_feature: GZ8MTXP02FFC1P.15.40.D07.1.454.CMB.2.raw
  modified_base (328)..(328): a, c, t, g, unknown or other
  modified_base (334)..(334): a, c, t, g, unknown or other
  modified_base (354)..(354): a, c, t, g, unknown or other
  modified_base (474)..(474): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctggggaggcttggtaaagccggggggtcccttaggactctcctgtgcagcctctggattcgctttcagtgacgcctggatgacctgggtccgccaggctccgagggagggctggagtgggtgcatataaagcaatgatgaaggtggacacagaccagcctccaccgtgaaaggcagattcaccatcncaaagngatgaattacccaaaaaacncgctgtctctacaatgaaacaacctgaaagaccgagacacagccgtagtattactgtaccaccgtgtcgggcctacgtactccgatggtgtctttgatatcgtgggaccaagggacaagnggtcaccgtctcttcacgtccttaccaccgacgggaccctagtcccgtcctttcccccgcggcccgtccctcgccaccgg

SEQ ID NO: 398967 - DNA, 538 bp, Homo sapiens
  misc_feature: GZ8MTXP02GLI50.15.40.D07.1.454.CMB.2.raw
  modified_base (272)..(272): a, c, t, g, unknown or other
  modified_base (352)..(352): a, c, t, g, unknown or other
  modified_base (536)..(536): a, c, t, g, unknown or other
tcagtctacgtagccacgaccggtgctcgatttagtgatagagcgtaacaacagaggactcaccatggaatttgggctgagctggattttccttgctgctattttaaaggtgtccagtgtgaggtgcagctggtggagtctgggggaggcttggtaaaggccggggggtcccttagactctcctgtgcagcctctggattcgctttcagtgacgcctggatgacctgggtccgccaggctccgagggagggctggagtggtgcatataaagnatgatgaggtggacaccagaccacgctccaccgtgaaaggcagattcacatctcaagagatagaattaacccaaaaaacncgactgtactacctaccaatcgaaacaacctagaacgacgagacacagaccgtgtattactgtaccacctggtcggacctactactcgatgtgtcttgatatcgtgggaccaggacagtcgtcaccgtctactcacgtctaccaccgaacggcccagtccggtcctcccgtcgccgcctcgccncg

SEQ ID NO: 398968 - DNA, 587 bp, Homo sapiens
  misc_feature: GZ8MTXP02GE8QE.15.40.D07.1.454.CMB.2.raw
  modified_base (331)..(331): a, c, t, g, unknown or other
  modified_base (335)..(335): a, c, t, g, unknown or other
  modified_base (350)..(350): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttgggtaaagccggggggtcccttagactctcctgtgcagcctctggattcgctttcagtgacgcctggatgacctgggtccgccaggctccgagggagggctggagtggtgcatataaagcaatgatgaaggtggacaccgagaccacgctccaccgtgaaaggcagattcaccatctnaagnatgataccaaaaacncgctactctacacatacgaaacaactagaacgacgagacacgacgacgtagtactactacgtaccctaccgtcggtcgggtaccctacgtaccgtaccgtagtggttcgttcgtttagattagtcggtacggggacgaaacgggaacgtaagtcgtacctaccgtccttctacgacgtcctaccgaccgaccggcctacgtccggtcccgttcccgtcgcccgtcctcgtccgtacg

SEQ ID NO: 398969 - DNA, 582 bp, Homo sapiens
  misc_feature: GZ8MTXP02JOQZ9.15.40.D07.1.454.CMB.2.raw
  modified_base (279)..(279): a, c, t, g, unknown or other
  modified_base (331)..(331): a, c, t, g, unknown or other
  modified_base (356)..(356): a, c, t, g, unknown or other
  modified_base (570)..(570): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtcgtgggggaggcttgggtaaaggccgggggggtcccttagactctcctgtgcagcctctggattcgctttcagtgacgcctggatgaccgtgggtccgccaggctccgaggggagggctggagtgggtgcatataaagnaatgatgaggtggacacagaccacgctccaccgtgaaagcagatcacatcanaagagatagaataacccaaaaaacncgtactagtctactaaccaatcgaaacaaaccgtagaaacgaccgaagaccacgacgccgtagtacttactacgtaccaccgtggtacgggtacctactacgtccgtagtggtcgttctttgatacgtcggtacggggaccgaagggacaagtcgtcaccgttctcttcacgtcctaccaccgacggcctacgtccgtccttccccgcggcccncctcgcctaccg

SEQ ID NO: 398970 - DNA, 732 bp, Homo sapiens
  misc_feature: GZ8MTXP02GFZ48.15.40.D07.1.454.CMB.2.raw
  modified_base (237)..(237): a, c, t, g, unknown or other
  modified_base (276)..(276): a, c, t, g, unknown or other
  modified_base (278)..(278): a, c, t, g, unknown or other
  modified_base (362)..(362): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctgggtggagtctgggggaggcttgggtaaaggccgggggggtcccttagactctcctgtgcagcctctggattcgctttcagtgacgcctggatgacctgggtccnccaggctccgagggagggctggagtggtgcatataaagnangatgaggtggacacagaccacgctaccaccgtagaaacggcagacttcaccatctacaagagatagaacttaacccaaaaaacncgtactgtacctacctaccaatacaaaccaaccgtagaaacgaccggaagaccaacgacgtaccgtagttaacttacgtacgtaacccgtaccgtcgggtacggggtacccttaaccgtaccgttaccggtaacgttgggttcgtttacgtttttacggaacgtttaacgttccgggttaccgggggaaccgtaaaacgggggtaaccgtaaacggttacgggtacccgtaaccccggtttcttacccgtttaccgtaccgttacccgtttaccccgaaacccgggtaaccgggtacccctacggtttccccggttccccctttcccccggtccggtacccccgtccccgtaccgtccccgtaacccggg

SEQ ID NO: 398971 - DNA, 633 bp, Homo sapiens
  misc_feature: GZ8MTXP02JF0IM.15.40.D07.1.454.CMB.2.raw
  modified_base (341)..(341): a, c, t, g, unknown or other
  modified_base (362)..(362): a, c, t, g, unknown or other
  modified_base (423)..(423): a, c, t, g, unknown or other
  modified_base (471)..(471): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccgggggggtcccttagactctcctgtgcagcctctggattcgctttcagtgacgcctgggatgacctgggtccgccaggctccgagggagggctggagtgggtgcatataaagcaatgatgaggtggacaccagaccacgctccaccgtagaaacggcagacttcacctatctacaaganatgaacttaacccaaaaaacncgtctagtctacctaccaaatgaaacctaactagaaacgaccgaaggaccacgagaccgtntaacttactgtacccacgtggtacgggctactactaccgtagtcggtnttcgtttagtatacgtcgtacgggggacctaagggaactaacgtcggtaccgtaccggttctacgttacgacgtaccttaccccgaaccgtaaaccgggtcccctaacgtcccggttaccccgttcccccggtcggaccccgtcccgtacggtccctaccgg

SEQ ID NO: 398972 - DNA, 591 bp, Homo sapiens
  misc_feature: GZ8MTXP02IVTAO.15.40.D07.1.454.CMB.2.raw
  modified_base (281)..(281): a, c, t, g, unknown or other
  modified_base (363)..(363): a, c, t, g, unknown or other
  modified_base (521)..(521): a, c, t, g, unknown or other
tcagtctacgtagccacgaccggtgctcgatttagtgatagagcgtaacaacagaggactcaccatggaatttgggctgagctggattttccttgctgctattttaaaaggtgtccagtgtgaggtgcagctggtggagtctgggggaggcttggtaaagccggggggtcccttagactctcctgtgcagcctctggattcgctttcagtgacgcctggatgaccgtgggtccgccaggctccgaggggagggctggagtggtgccatataaagcaatgangaggtggacaccagaccacgcctccaccgtgaaacggcagattcacctatctacaaagagatagaatttaaccaaaaaaccncgtactagtacctactacccatacgaaacaaccgtagaacgacgaggacacagccgtatattactgtaccaccgtaggtcgggcctactactcgagttggtgttctttagatacgtcggtcgggaccaagggacagtacggtctaccgttctcgttcncgtccctaccgaccgtacggtcccacgttcccgtcccgttcccgtcggtcccgtcccgtcgccgtaccgg

SEQ ID NO: 398973 - DNA, 406 bp, Homo sapiens
  misc_feature: GZ8MTXP01EVKHP.13.60.F05.1.454.CMB.2.raw
  modified_base (401)..(406): a, c, t, g, unknown or other
tcagtcacgtactacacgaccggtgctcgatttagtacgtcatcagggaaagggccacgctctcctgtagggccagtcagagtgttaacagcaacttcttagcctggtaccagcagaaacctggccaggctcccaggctcctcatatacggtgtgtccactagggccactgacatcccagacaggttcagtggcagtgggtctgggacagacttcactctcaccatcagcagactggagcctgaagattttgcagtttatactgtcaccagtatggcacctcaccgctcactttcggcgagggaccaaggtgagatcaaacgaactgtggctgcacccatctgtctcaatcttcccgcatctgatagtacgtgactgagcgggctggcaaggcgacatagnnnnnn

SEQ ID NO: 398974 - DNA, 409 bp, Homo sapiens
  misc_feature: GZ8MTXP01A43S4.13.60.F05.1.454.CMB.2.raw
  modified_base (247)..(247): a, c, t, g, unknown or other
  modified_base (400)..(400): a, c, t, g, unknown or other
  modified_base (403)..(409): a, c, t, g, unknown or other
tcagtcacgtactacacgaccggtgctcgatttagtacgtcatcagggaaagggccacgctctcctgtagggccagtcagagtgttaacagcaacttcttagcctggtaccagcagaaacctggccaggctcccaggctcctcatatacggtgtgtccactagggccactgacatcccagacaggttcagtggcagtgggtctgggacagacttcactctcaccatcagcagactggagcctgaagnttttgctagtttatactgtcacagtatggcacctcaccgctcactttcggcggaggaccaaggtggagatacaaagactgtggctgcacccatctgtcttcaatccttcccgctatctgatagtacgtgactgagcgggctggcaaggcacanagnnnnnnn

SEQ ID NO: 398975 - DNA, 418 bp, Homo sapiens
  misc_feature: GZ8MTXP02JTYFK.13.60.F05.1.454.CMB.2.raw
  modified_base (335)..(335): a, c, t, g, unknown or other
  modified_base (412)..(418): a, c, t, g, unknown or other
tcagtcacgtactacacgaccggtgctcgatttagtacgtcatcagggaaagggccacgctctcctgtagggccagtcagagtgttaacagcaacttcttagcctggtaccagcagaaacctggccaggctcccaggctcctcatatacggtgtgtccactagggccactgacatcccagacaggttcagtggcagtgggtctgggacagacttcactctcaccatcagcagactggagcctgaagtattttgctagtttattactgtcaccagtatggcacctcaccgctcactttcggcggaggaccaaggtggagatacaaacgactgtgcngcacccatctgtcttcactcttcccgccatctcgatacgtacgtacgactgaggcgggcgtggcgaggcgacatagnnnnnnn

SEQ ID NO: 398976 - DNA, 461 bp, Homo sapiens
  misc_feature: GZ8MTXP02JW437.13.60.F05.1.454.CMB.2.raw
  modified_base (337)..(337): a, c, t, g, unknown or other
  modified_base (372)..(372): a, c, t, g, unknown or other
  modified_base (453)..(461): a, c, t, g, unknown or other
tcagtcacgtactacacgaccggtgctcgatttagtacgtcatcagggaaaggggctggagtggattggggaaatctatcatagtgggaccacctactacagcccgtccctcaatagtcgcgtcaccatgtcagtggacgagcccagaaccagttctccctgagcctgacctctgtgaccgccgcggactcggccctatacttctgtgcgagagatcgagatgtgtcatcggcggggcacttttgatatcgtggggccaaggggtcgatggtcatcgtctcttcagcctccaccaagggcccatcggtcttccccctggccgccctgctccagggcncacctccgagcgcaccgagccggcccctggggccncgtccgtcggtacgaaacttaccgtaccttaccgtacgtacgtcgacgtggacggcgggtcgtgggacgaggcgacagagnnnnnnnnn

SEQ ID NO: 398977 - DNA, 428 bp, Homo sapiens
  misc_feature: GZ8MTXP02GA34N.13.60.F05.1.454.CMB.2.raw
  modified_base (339)..(339): a, c, t, g, unknown or other
  modified_base (419)..(419): a, c, t, g, unknown or other
  modified_base (421)..(421): a, c, t, g, unknown or other
  modified_base (424)..(428): a, c, t, g, unknown or other
tcagtcacgtactacacgaccggtgctcgatttagtacgtcatcagggaaaggggctggagtggattggccgtattaaaagtgagcctgatggtgggacaacagactacgctgcacccgtgaagggcagattcaccatctccagagatgattcaaggaacacagtgtttctgcaaatgaacagcctgactgccggggacactgccgtgtattactgtgccagcagcagtacctggccacttatattttttgacttctggggccagggaacccctggccaccgtctcctcagcttccaccaaggcccatcggtcttcccctggcgccctgctccaggacncacctctggggccacgagcggccctgggcctgcctggtcaaggactacttctagtcgtgactgagcggctggcaaggcgnanagnnnnn

SEQ ID NO: 398978 - DNA, 522 bp, Homo sapiens
  misc_feature: GZ8MTXP02JN98W.13.60.F05.1.454.CMB.2.raw
  modified_base (499)..(522): a, c, t, g, unknown or other
tcagtcacgtactacacgaccggtgctcgatttagtacgtcatcagggaaaggggctggagtggattggggaaatctatcatagtgggaccacctactacagcccgtccctcaatagtcgcgtcaccatgtcagtggacgagcccaagaaccagttctccctgagcctgacctctgtgatcgccgcggactcggccctatacttctgtgcgagagatcgagatgtgtcatcggcggggctacgttttgatatcgtggggccaagggtcgatggtcatcgtctcttcacgccctccaccgaaggccccatccgggtccttccccccgtggcccgtcccctgccctcccgaggacgccaaccctccggaagacgacccaccgaggcccggtccccgtggggcccttcgcccgtgggtaccaaacgggtaccttaccgttcccgtagttacgtagtacctggacgggccggggctggggaccgaaggggccacgaagtaggnnnnnnnnnnnnnnnnnnnnnnnn

SEQ ID NO: 398979 - DNA, 503 bp, Homo sapiens
  misc_feature: GZ8MTXP01BPODE.10.1.A01.1.454.CMB.2.raw
  modified_base (341)..(341): a, c, t, g, unknown or other
  modified_base (369)..(369): a, c, t, g, unknown or other
  modified_base (417)..(417): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccaggccaccctcccaagctcctctccgacaggaactaacactcccggccctcagggactcctcagagagattcnctgcatccagtcaggagcacagcctccngacattactggactcagctgacgacgaaggctagtattatactgtctnacgctagtcggacaccggcctcgagtgcggtgggtttcggcgggttacggacgaagcgtgaccgtcgttaggtcgaacgaacccgg

SEQ ID NO: 398980 - DNA, 503 bp, Homo sapiens
  misc_feature: GZ8MTXP01A9MDL.10.1.A01.1.454.CMB.2.raw
  modified_base (378)..(378): a, c, t, g, unknown or other
  modified_base (414)..(414): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttgccacgacggagtcgttggctgcagcagcaccagggccaccctcccaagctcctctccgacacggaactaacactccggccctcacggggatcctcagagagattctctgcatccagtcagagcacagcctcctgaccattacnggactccgagctgacgacgagctgattatactgctnagctagtcggacaccggtctcgagtcgttcgtgggtttcggcgggttcggaccgaagcgtcgtaccggtcttacggtcgaacgaacccg

SEQ ID NO: 398981 - DNA, 508 bp, Homo sapiens
  misc_feature: GZ8MTXP01DQQA1.10.1.A01.1.454.CMB.2.raw
  modified_base (342)..(342): a, c, t, g, unknown or other
  modified_base (371)..(371): a, c, t, g, unknown or other
  modified_base (381)..(381): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctccctctccgacaggaactaacatcccggccctcagggactcctcagagagattcnctgcatccaggtcaggagcacagcctccngaccattacnggactcaggctgacgacgaagctagattatactgctacagctagtcggacaccggcctcgagtgcgttgggtttcggcgggttcgggaccaaggctcggacccgtccgttacgggtcaacgaacccg

SEQ ID NO: 398982 - DNA, 530 bp, Homo sapiens
  misc_feature: GZ8MTXP01A4L6Q.10.1.A01.1.454.CMB.2.raw
  modified_base (350)..(350): a, c, t, g, unknown or other
  modified_base (368)..(368): a, c, t, g, unknown or other
  modified_base (391)..(391): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccacccctcccaacgcctccctctccgacaggaactaacactcccggccctcgaggggactccctcagagagattcnctgcatccaggtcaggancacagccctccctgaccattacnggacctccgaggctgacgacgagctagtattatactgctcgagctagtcggaccaccggctcgagtcggcggttcggggtttcggcgggttacgggaccgaaggcgtcggccgtccgttacggtccgaacggaacccgg

SEQ ID NO: 398983 - DNA, 500 bp, Homo sapiens
  misc_feature: GZ8MTXP01E1H5U.10.1.A01.1.454.CMB.2.raw
  modified_base (393)..(393): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggcccaccctcccaagctcctctccgacaggaactaacactcccggccctcgagggatcctcagagagattctctgcatccaggtcaggagcacagcctcctgaccattactggactccgagcngacgacgaagctgattatactgctcagcagtcgggacaccggctcgagtcggcggttgggtttcggcggacgggacgaagcgtcgccgtcgttacgtcgcgaacccg

SEQ ID NO: 398984 - DNA, 477 bp, Homo sapiens
  misc_feature: GZ8MTXP01EKOXS.10.1.A01.1.454.CMB.2.raw
  modified_base (315)..(315): a, c, t, g, unknown or other
  modified_base (336)..(336): a, c, t, g, unknown or other
  modified_base (407)..(407): a, c, t, g, unknown or other
  modified_base (413)..(413): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggccaccctccaagctcctctccgacaggaataacatccggccctnagggatcctcagagagattcnctgcatccagtcaggaagcacagctcctgaccattactggactccagctgacgacgaaggctgattatacngctcancatggacaccggctcagtgcgtgggtttcggcggttggacaagctcgacgtcaggtcgcgcccg

SEQ ID NO: 398985 - DNA, 517 bp, Homo sapiens
  misc_feature: GZ8MTXP01CZR80.10.1.A01.1.454.CMB.2.raw
  modified_base (423)..(423): a, c, t, g, unknown or other
  modified_base (427)..(427): a, c, t, g, unknown or other
  modified_base (474)..(474): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactgggaacaacaacaatgttggccacgacggagtcgttggctgcagcagcaccgaggcccaccctccaagctcctctccgacaggaactaacactccggcctcagggactcctcagagagattctctgcatccgaggtcaaggacgcacacgccctccagacctattacgtcggactccgaggctagaacgacgagtctgtattactacngctnacgctagtcgggacaccggctcgagtcgcggttgggttcggacgggnggacccaaggcgtcggtacccgtcgttacgtcgaacgaacccg

SEQ ID NO: 398986 - DNA, 509 bp, Homo sapiens
  misc_feature: GZ8MTXP01A3M0E.10.1.A01.1.454.CMB.2.raw
  modified_base (381)..(381): a, c, t, g, unknown or other
  modified_base (431)..(431): a, c, t, g, unknown or other
  modified_base (465)..(465): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcaggcaccgaggccaccctccaacgctcctctccgacaggaataacatccggcctcagggatccctcagagagattctctgcagtccaggtcaggaacgcacacgcctcctgaccattacnggactccgagctgacgacgaagctgattatactgctcagctagtcggacnccgggctcgagtcgcggttcgggtttcggcgggngggttaccaaggcgtcggccgtccgttaggtccgaacgaacccg

SEQ ID NO: 398987 - DNA, 508 bp, Homo sapiens
  misc_feature: GZ8MTXP01D3QPS.10.1.A01.1.454.CMB.2.raw
  modified_base (340)..(340): a, c, t, g, unknown or other
  modified_base (368)..(368): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccaccctccaagctcctctccgacaggaactaacatccggccctcagggactcctcagagagattcnctgcatccagtcaggagcacagcctccngaccattactggactcagctgacgacgagctgattatactgctcagcatcgggacaccggctcgagtcgttcggtcgggtttcgggcgggttgggaccgaaggtcgtcggtacccgtcgttacggtcgaacgtaacccgg

SEQ ID NO: 398988 - DNA, 552 bp, Homo sapiens
  misc_feature: GZ8MTXP01CLPIK.10.1.A01.1.454.CMB.2.raw
  modified_base (462)..(462): a, c, t, g, unknown or other
  modified_base (476)..(476): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgtcggccacggacggagtcgtttggctgcagcagcaccgaggccccacccctcccaagcctcctctaccgacaggaaactaacactcccggccctagacgggatccctcagagagtattctctgcaatccgaggtacaaggaacgccacacgccctacccgtagaaccctagttactacggacctaccgagggcctaggacgaacgacggtctagtattactactgcctnagcagtcgggaccnccggtctcgaggtcgcggttgggtttcggcgggttacggaccaaggccgtcgaccgtcgttacggtcgcgaacccg

SEQ ID NO: 398989 - DNA, 491 bp, Homo sapiens
  misc_feature: GZ8MTXP01EHOG8.10.1.A01.1.454.CMB.2.raw
  modified_base (338)..(338): a, c, t, g, unknown or other
  modified_base (413)..(413): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggccaccctcccaagctcctctccgacaggaataacactccggccctcagggctcctcagagagattcnctgcatccagtcaggagcacagcctcctgaccattactggactcagctgacacgaaggctgattagttactgctnacgctagtcgggaccaccggctcgagtcgcgtgggtttcggcggcggactaagcgtcgaccgtcttaggtcgcgcccg

SEQ ID NO: 398990 - DNA, 744 bp, Homo sapiens
  misc_feature: GZ8MTXP01CGFOB.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgcacactcacctgacactaggaaacaacaacaatgtggccacgacggagtcgttggctgcagcagccaccgacgggccccacccctcccaacgcctcctccgtaccgacaacggtaaactaaccgacgtcccggccctacgaacggggacttaccccgtacgaaggacgtacgtaactttcctactcggacctaacgtacccgtagggtaccgaaacggggaaacacccaacgaccgtacccctaccccgtacggaacccttaacgtttaccgttaccgggaaccttacccggaacgggaccgttaacggaaaccgaaaccggtaaacggggtacgtttaacggttaaacgtttaaacttaccgtacggtaccttacgaacgtacgtaacggtaccgggtaacccgaacccgggtccgttacgttacgggttcggttcggggtttacgggggttttccgggaccgggggacgggttaacccggtaacggtccgtaaccgggtacccggtacccggttacgggtaacccgaaccggtaacccccggg

SEQ ID NO: 398991 - DNA, 522 bp, Homo sapiens
  misc_feature: GZ8MTXP01AS0TC.10.1.A01.1.454.CMB.2.raw
  modified_base (433)..(433): a, c, t, g, unknown or other
  modified_base (446)..(446): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccaccctcccaacgcctcctctaccgacacggaataacactccggccctcagggactccctcagagagattctactgcatccaggtcaggagcacagccctcctgaccattacgcggactccgagctagacgacgaacgctagtattactactgctcgancctagtcgggacnccggctcgaggtgcggttggggtttcgggcgggttcgggacgaacgcgtcggccgtcgttacggtcgcgaacccgg

SEQ ID NO: 398992 - DNA, 538 bp, Homo sapiens
  misc_feature: GZ8MTXP01EE000.10.1.A01.1.454.CMB.2.raw
  modified_base (376)..(376): a, c, t, g, unknown or other
tcagcatagtagtgcacgaccggtgctcgatttagacgtctcatcagggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgcacgacggagtcgttggctgcagcagcaccagggcccaccctcccaagctcctctccgacaggaataacactcccggccctcgagggactccctcgaagagagtattctctgcatccgaggtcaggaagcacacgccctccngaccattacgcgactccaggctaggacgacgaaggctagtatttactactgctcgagcagtcgggaccaccggtcctgagttcggttcggttcggggtttcggcgggttacggaccgtaacggcgtcgtacccggtcgttacggccgttaacggaaccccgg

SEQ ID NO: 398993 - DNA, 603 bp, Homo sapiens
  misc_feature: GZ8MTXP01ERQXM.10.1.A01.1.454.CMB.2.raw
  modified_base (366)..(366): a, c, t, g, unknown or other
  modified_base (382)..(382): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccaggcccaccctccaacgctcctctaccgacaggaactaacacgtccggccctcgaggactccacagagagtactctctgcatacccgaggtccagggaanccacgacgccctccgngaaccctagtttaacgcggtacctaccgaggcctaggaacgaacgaacggtctggtaatttactaactcgctcgaaggcaaggtacggggaccacccgggtctcgttacggttcgggttccggtttgggggtttaccgggaccggggacggggaaccccgtaaaggtcccgttaacgggaccccggttaccggttacggtaacccgaacggaacccccggg

SEQ ID NO: 398994 - DNA, 740 bp, Homo sapiens
  misc_feature: GZ8MTXP01EJSIL.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccgacgggcccacccctcccaacgcctccctctaccgacaaggaacttaacacgttcccggaccctacgacggggtactcctacgaaggagacgtactttctctcgactacttcccgagggtcgaaggggaaacgccaaccgacgtccccttccctacggtaaccctaacgtttaacccgtacgggtaacccttaccccggtaacgggacccttaacgggaaacccggaaaccggtaaacgggggttacctttagggttaaacttttaaactttaaccgtcgtaccttacgaacgtccgtaacggttaacggggaccccgaacccggggtccccttaggttacggggtttcgggttcggggtttaccggggggttttaccggggaccgggggttacggggttaaacccgaaacgggtcccgttaacgggtaccccggttaccggttaacgggtcccgttaaccggaacccccggg

SEQ ID NO: 398995 - DNA, 521 bp, Homo sapiens
  misc_feature: GZ8MTXP01CMY4F.10.1.A01.1.454.CMB.2.raw
  modified_base (361)..(361): a, c, t, g, unknown or other
  modified_base (423)..(423): a, c, t, g, unknown or other
  modified_base (437)..(437): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatcccaaggacttgagacagaccgccacactcacctgcactgggaacaacaacaatgttggccacgacggagtcgtttggctgcagcagcaccagggccaccctcccaagcctcctctccgacaggaactaacatccggccctcagggactcctcagagagattctctgcatccaggtcaggacncacagcctcctgacctattactggactccgagctgacgacgaaggctgtattattactgctnagcagtcgggaccnccggcctcgaggtcgcggttggggtttcgggcgggttagggacccgaaggcctcggaccgtccgttaggtccgaacgaaccccg

SEQ ID NO: 398996 - DNA, 533 bp, Homo sapiens
  misc_feature: GZ8MTXP01DDOOE.10.1.A01.1.454.CMB.2.raw
  modified_base (345)..(345): a, c, t, g, unknown or other
  modified_base (363)..(363): a, c, t, g, unknown or other
  modified_base (375)..(375): a, c, t, g, unknown or other
  modified_base (385)..(385): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccgaggcccaccctcccaagcctcctctccgacaggaactaacactccggccctcgagggactcctcagagagacttcnctgcatccaggtcaggancacacgcctccngaccattacncggactccgagctgacgacgaaggctgtacttactactgctcagctagtacgggaccaccgggcctgacggtcggttcgggttcggggtttcgggacgggttcgggaccgaaggctcggaccgtcgttacggtccgaacgtaaccccg

SEQ ID NO: 398997 - DNA, 531 bp, Homo sapiens
  misc_feature: GZ8MTXP01A52V8.10.1.A01.1.454.CMB.2.raw
  modified_base (414)..(414): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcatggctgactcagccaccctcggtatccaaggacttgagacagaccgccacactcacctgcactgggaacaacaacaatgtggccacgacggagtcgtggctgcagcagcaccagggccaccctcccaagcctcctctccgacaggaactaacatccgcctcacgggactctcagagagaattctctgcatcccgaggtacaggaagcacgacgccctcctgacctatactcggactccgagctagacgacgagctgaattntactgctacagcagtcgggactaaccggcttcgagttcggtacggttcggggtttacgggcggacggggaaccacggtcgtacgggtacccgttaccgtaagggttccgaacccggg

SEQ ID NO: 398998 - DNA, 575 bp, Homo sapiens
  misc_feature: GZ8MTXP01EKNHB.10.1.A01.1.454.CMB.2.raw
  modified_base (289)..(289): a, c, t, g, unknown or other
  modified_base (451)..(451): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccacggccaccctcccaagctccnctccgacaggaactaacactccggccctgacgggactcctcaagagagtacttctacgtgctactcccgaagggtcaagggaacgccacacgaccctcccgtacgaccattacctggacctccgaggctacgacgacgaacggactgtaattacttacgtcnctacgacgcgtacggtacggaccgccggtcctcggttacggtcggttcgggttcggggttacgggacggggttacggaccgaagtcgtaacggtaccgtccgttacggtccgaaccggtaaccg

SEQ ID NO: 398999 - DNA, 728 bp, Homo sapiens
  misc_feature: GZ8MTXP01DAKOY.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccacctcggtatccaaggactgagacagaccgccacactcacctgacactagggaaacaacaaactaatgttacggaccgacggacggagttcgtttggctgcagcagcaccgaggcccaccctccaacgctcctctaccgacaaggaactaacacgtccggcctacgaggtactcctacaggacgtacgtacttccttctcgactacgtacccggaacggtccgaagggaaacgaccaaccgtaccgtaccccttcccgtacggtacccttaaagtaaccgttacgggaacccttcccggaacggaccgttaacggaaaccgaaacgggaaacgttaccgttaaggttaaactttaaccggttaacttccggtacccttaacgacgggtacctaacgggttaccggggtaaacccgcccggggttaaccctacggttacgggtttaccgggttccgggggtttttcgggggtttccggggacggggttacggttaacccggaaacggtcggtaacccggtaccggggttaccgttacgggttcccgaaccggtaaccccgg

SEQ ID NO: 399000 - DNA, 540 bp, Homo sapiens
  misc_feature: GZ8MTXP01AF7T1.10.1.A01.1.454.CMB.2.raw
  modified_base (342)..(342): a, c, t, g, unknown or other
  modified_base (361)..(361): a, c, t, g, unknown or other
  modified_base (446)..(446): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgttggctgcagcagcaccagggcccaccctcccaagctcctctccgacaggaataacactccggccctcgaggggactcctacagagacgattcnctgcatccaggtcagggancacagcctcctcgacctacttactcggactcgaggctagacgacgaaggctagtattacttactgctcgagccgagtcgggaccnccgggcctcgaggtcggttcggttcggggtttcgggcgggttacgggaccgaacggcgttcggaccgtccgttacggtccgaacggtaacccgg

SEQ ID NO: 399001 - DNA, 854 bp, Homo sapiens
  misc_feature: GZ8MTXP01CEH7C.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttgcgtgcgagacgagacgaccacggccgacccctaccccaccgacgtcctccctaccgtaccgaacggaaacgtaaacctaacgtacccggtaccccgtacccgtaacgggaacggtaccccctcgtaacggaaggtaacggtaacgtttaaaccttccgtcggtacctacgttaacccgtaacggtaccggtaaacgggaaacggggaacctaacccgaaccggtaccccggttacccccttaccggtaaccctaaacccgtttaaaccgtttacccgggggtaaccttaccccgtacgggaaccggttacggtaaccgggtaaacccgggaaacggggtaacccgtttacgggttaaagttttaacgttttaaaccttaccgtaccggttacttaaacccggtcgaaacggtttaccggggtaacccggaaccccgggtccccggttaccgttaacggggtttcggttaccgggggtttccggggggttttttccggggttaaccgggggttaccgggggaaacccggtaacgggtaacggttcccggtaaacccgggtcccggtttaacggggttccggttaacccgtaacccccggggg

SEQ ID NO: 399002 - DNA, 535 bp, Homo sapiens
  misc_feature: GZ8MTXP01D414M.10.1.A01.1.454.CMB.2.raw
  modified_base (358)..(358): a, c, t, g, unknown or other
  modified_base (439)..(439): a, c, t, g, unknown or other
  modified_base (490)..(490): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcaccgacgggcccacccctcccaacgcctccctctacccgaacacggaactaacgacgtcccggaccctcgagggactccctacgagagagtattccnctgcactccgaggtacagggacgcacacgcctccagacctatacgtcgactcgagctgacgacgaggctagtacttatacngctcgagcgtagtcggacctccggctgacgtcggttcggttggggttcggngggcggacgaacggtcgtcggccgtcgttacggtcgcggaacccg

SEQ ID NO: 399003 - DNA, 513 bp, Homo sapiens
  misc_feature: GZ8MTXP01EL0BI.10.1.A01.1.454.CMB.2.raw
  modified_base (336)..(336): a, c, t, g, unknown or other
  modified_base (358)..(358): a, c, t, g, unknown or other
  modified_base (365)..(365): a, c, t, g, unknown or other
  modified_base (413)..(413): a, c, t, g, unknown or other
  modified_base (431)..(431): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagcaccagggccaccctccaagctcctctccgacaggaactaacatccggcctcgaggctccctcagagagattcnctgcatccaggtcaggagcacngcctccngaccattactcggactcgaggctacgacgacgaggctagattattacngctcaagctagtcggacnccggctcgagtggacggttcgggtttcgggcggttacggaccaaggtcgtcggaccgtcgttacggtccgaacggaaccccg

SEQ ID NO: 399004 - DNA, 629 bp, Homo sapiens
  misc_feature: GZ8MTXP01DAAOT.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccacctcggtatccaaggacttgagacagaccgccacactcacctgacactaggaacaacaacaatgtcggccacggacggagtcgttggctgcagcagcaccgacggcccaccctcccaacgcctcctctccgacaggaactaacacgtccggccctacgagggactcctcagagagtacttctctgactacgtaccgagggtacaacgggacaccgaacaccgtcccctacccgtacgaaccctaacgttaccgtacgggtacctaccgacggtcgacgaaccggaacgaacggtcttaagtacttaacttaacctgccctagaacgcgtacggtcgggacccgtcccggtcctacggttacgggtcggttcggggtttcggggtttaccgggacggggttacgggaacccgtaaggccgtcggtacccggtcggttaacggtccgaaccggtaaccccgg

SEQ ID NO: 399005 - DNA, 532 bp, Homo sapiens
  misc_feature: GZ8MTXP01BW07N.10.1.A01.1.454.CMB.2.raw
  modified_base (351)..(351): a, c, t, g, unknown or other
  modified_base (371)..(371): a, c, t, g, unknown or other
  modified_base (375)..(375): a, c, t, g, unknown or other
  modified_base (392)..(392): a, c, t, g, unknown or other
  modified_base (425)..(425): a, c, t, g, unknown or other
  modified_base (429)..(429): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttgccacgacggagtcgttggctgcagcagcaccagggcccacccctcccaagcctccctctaccgacaggaactaacactcccggccctcgagggactccctacgagagagtacttcnctgcatcccaggtcagggancacncgcctcctgaccatacngactcaggctagacgacgagctagtattatacngctnagctagtcggaccacggtctcgaggtcggttcggttcggggtttcggcggggacggaccgaaggccgtcggacccgtcgttacgggtccgaacgtaaccccgg

SEQ ID NO: 399006 - DNA, 703 bp, Homo sapiens
  misc_feature: GZ8MTXP01D8ZZ5.10.1.A01.1.454.CMB.2.raw
  modified_base (349)..(349): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggtagtcgttggctgcagcagcacgacggcccaccctccaagctcctctaccgacgaggaactaacgacgtccggcctacgaggactcctacgagagagtacttcnctgctacgtccgaggtccgaaggaaacgccaccgacgtccctaccctacggaacctacgtttaaccgtacgggtacccttacccggagggaccgttacgggaaccgaaacggtaaacgggggtaccttaaggttaacttttaacgttaaccgtcggtaccttacggaacggtacgtaacgggttaccgggaaccggtaccccgggtcccgttacggttaacggttccggggttccggggtttacggggggttttacccggggaccgggggttacgggaacccggttaacggcccgttaacgggtaccccgggttaccggttacgggtaacccggttaaccggtaacccccgggg

SEQ ID NO: 399007 - DNA, 690 bp, Homo sapiens
  misc_feature: GZ8MTXP01B02E1.10.1.A01.1.454.CMB.2.raw
  modified_base (356)..(356): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactggaacaacaacaatgttagaccacgacggagtcgttggctgcagcagcaccgaggcccaccctccaacgcctccctcctaccgacaaggaactaaccgacgtcccggaccctgacgggactcccgtacagagacgtattcnctgactacgtcccgaggtacagggaacgccaacacgccctaccctacggaaccctaattaccgttacgggacccttacccgacgggtacctacggaaacgaaccggaaacgggtcgttaaggtaaactttaacttaaccgtcggtaccttacgaaacgtcgtaaacggttaccgggaacccgaccccgggtaaccgttccggttaacgggttcgggttaccggggtttacgggggttttcccggggaaccggggttacgggaacccgtaaagggtcccgttaaccgggtaccccggttaccggttaaccggttccgaacccggtaacccccggg

SEQ ID NO: 399008 - DNA, 689 bp, Homo sapiens
  misc_feature: GZ8MTXP01DDUTN.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttcggccacggacggagtcgttggctgcagcagccaccgaggcccacccctcccaagcctccctctaccgacaggaactaaccacgttcccggccctacgagggactcctcgagagagtacttcctcttggactacgttcccgagggtacaagggtacgccacgacgtcccctacccgtacgacccttaacgttacgtcggaaccttcccggacgggtacccgttacgggaaaccgaaccggtaaacggggtacctttaggtaaacttttaacgtttaccgtacggtccttacgaacgtccgtaacggttaccggggaccctacccgggtcccttacggttacgggttcgggttccggggtttacgggggttttccgggacgggggttacgggaacccgtaaggtccgtaacggtaccccggttaccgttacgggttccgaaccggtaaccccggg

SEQ ID NO: 399009 - DNA, 647 bp, Homo sapiens
  misc_feature: GZ8MTXP01EE0XG.10.1.A01.1.454.CMB.2.raw
  modified_base (373)..(373): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttggccacgacggagtcgttggctgcagcagcaccacggccaccctcccaacgctcctctaccgacaggaactaacacgtcccggcctacgagggactcccgtcagagagtattctctgacatccaggtacaagggaacncacacgcctacccgtacgaacctacttacgtacggtacctcccgaaggcctacggacgaacgaagggtactagtactttacttaactcgtctacgacgcttaacgtacggggaccgaaccccggggtccttacgacgggttcgggttaccgggtttacggggggttttcccgggaccgggggttaacggggaccccgtaacggggtacccgtttaaccgggtacccccggttaccggttaaccggggttccccgaaccggggtaaccccccggg

SEQ ID NO: 399010 - DNA, 583 bp, Homo sapiens
  misc_feature: GZ8MTXP01C6NN1.10.1.A01.1.454.CMB.2.raw
  modified_base (419)..(419): a, c, t, g, unknown or other
  modified_base (461)..(461): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgcacgacggagtcgttgctgcagcagcaccgaggcccaccctcccaagcctccctctccgacaggaaactaaccacgtcccggaccctcgaggggactccgtaccaggagacgtactttaacctctcggactactaccgagggtacaagggaacgcaacacgcccctccctagaccctaatttacgnggtaacctcgagtcagaacgacgaaggtctgtaattagtacngtactcagcctagtacggaccacggtcctgacggtcggcgggtttacgggttcggggaacgggttcgggacctaaggtcgtaacggtacccggtaccgttagggtccgaacggtaaccccgg

SEQ ID NO: 399011 - DNA, 534 bp, Homo sapiens
  misc_feature: GZ8MTXP01DJ3CW.10.1.A01.1.454.CMB.2.raw
  modified_base (452)..(452): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccaccctcccaagctccctctaccgacaggaactaacactcccggccctcgagggactcctcagagagattctctgcatccgaggtcaggagcacacgcctccctgacctattactcggacctccgaggctaggaacgacggaagctagtacttacttactgctcgagtcagtggaccnccggctcgagtcggcggttggggtttcggcgggttcgggacctaaggtcgtcggtccgtcgttacggtcgaacggaacccgg

SEQ ID NO: 399012 - DNA, 742 bp, Homo sapiens
  misc_feature: GZ8MTXP01D4OYM.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttcggccacggacggtagtcgttggctgcagcagccaccgacgggcccacccctcccaacgtcctccctccgtaccgacaacggtaaactaaccgacgtccccggaccctcgacgggtactacctaccgagaagacgtactttcctctgctacgtacccgtagggtaccgaaggggaacgaccaacgaccggtacccctacccgtacggaaacccttaacgtttaaaccggtcgggtaacccttaccggaacgggtccgttaaacgggaaaccggtaacccggaaagggggtcccttaagggttaaacttttaactttaaccgtcggtacccttacggaaacggtccgtaaacgggttccggggaaacccgtaccccgggtaacccgttaccggaggggtttccgggttaccggggttttacggggggttttaccggggacccggggttaacgggaacccgaacgtccgtaacggtaccccggtcgttacggtccgaacgtaaccccgg

SEQ ID NO: 399013 - DNA, 535 bp, Homo sapiens
  misc_feature: GZ8MTXP01BYTWE.10.1.A01.1.454.CMB.2.raw
  modified_base (288)..(288): a, c, t, g, unknown or other
  modified_base (336)..(336): a, c, t, g, unknown or other
  modified_base (356)..(356): a, c, t, g, unknown or other
  modified_base (432)..(432): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttgccacgacggagtcgttggctgcagcagcaccagggccacccctccaagctccnctcgacaggaataacatccggccctcagggatccctcagagagattcnctgcatccagtcagagcacngcctcctgaccattacgtgactccgaggctgacgacgacgggactagtattattactgctcgagctagtcggaccnccggcctcgacggtcggcgggttcggggttttccgggcggggacgggaacccgaagggtcgtaacggtacccgtaccgttacgggtccgaacggtaaccccgg

SEQ ID NO: 399014 - DNA, 823 bp, Homo sapiens
  misc_feature: GZ8MTXP01DEQ8C.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgcacactcacctgcactaggaacaacaacaatgtcggaccacgacggagtcgttggctgcagcacgcaccgacggcccaccctccaacgcctccctctacccgaacaacggaaactaaaccgaccgtccccggacccctacggaacggggtactaccccgtaccgaaggtaacgtaacggtactttccctacgtaacggtaccctaaacgttacccccggtaaaggggttaccccgaaaggggtaaaccggaccctaaacccgaacccggtcccccttacccccgtaaccgggtaaaccccttaaacgtttaacccggtttaccgggaaacccgtttaccccgggaaacgggacccgttaaccgggaaacccggtaaacccggtaaacggggtccgtttaaacggttaaaccttttaaccggtttaaacctcggtacccttacgaaccggtaccgtaacggttaccggggaacccgtaaccccgggtccgttacggttaacgggttcgggttccggggttttacgggggttttaccggggacgggggttaccgggaacccggtaacggtcccgttaacgggtaccccggtaccggttacgggttaaccgaaccgggtaaccccgg

SEQ ID NO: 399015 - DNA, 570 bp, Homo sapiens
  misc_feature: GZ8MTXP01ACFHO.10.1.A01.1.454.CMB.2.raw
  modified_base (370)..(370): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagcaccagggcccacccctcccaagcctcctctccgacaggaataacacgtcccggccctcgagggactcccgtcagagagacttctctcgcactccgaggtcagggacnccacacgccctcccagaccattacgcggactccgaaggtcacgacgacgaacggctagtattacttactcgctcgacgctagtcgggacccaccgggcctcggaggtcggttcgggttcggggtttacgggcgggttacgggaccgtaagggtccgtaacgggtaccccgtaccgttacggtccgaaccggtaaccccgg

SEQ ID NO: 399016 - DNA, 714 bp, Homo sapiens
  misc_feature: GZ8MTXP01DFK2Z.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactgggaacaacaacaatgttggccacgacggagtcgttggctgcagcagcaccgacggcccaccctccaagcctcctcaccgacaggaaactaacactcccggaccctgaggactccacagagagtacttcgtctcgactacgtaccgtaacgggtacaacggggaaacgcctaaccacgtaccccttaccccgtacgtaacccttaacgtttaaccgttacggacccgttacccggaacggggccttaacgggaaaccggtaaaccggaaaggggtaccttaggttaaacgtttaactttaaccgtcggtaccttacgaaacggtcgaacggttaccggggaaccgtaaccccggggtcctccggttaagggttcgggttccggggttttcgggggttttacccggggaacgggggttacccgggaaacccggaaacgggtccgttaaccgggtaccccggttaccggttaaccgggttaaccgaaccgggtaaccccgg

SEQ ID NO: 399017 - DNA, 532 bp, Homo sapiens
  misc_feature: GZ8MTXP01BTWMV.10.1.A01.1.454.CMB.2.raw
  modified_base (348)..(348): a, c, t, g, unknown or other
  modified_base (440)..(440): a, c, t, g, unknown or other
  modified_base (454)..(454): a, c, t, g, unknown or other
  modified_base (523)..(523): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgtttggctgcagcagcaccagggcccacccctcccaacgcctcctctaccgacaggaactaacactccggccctcgagggctcccgtcagagagtattcnctgcatccgagtcaggaacgcacacgccctcccgtagacccagttaccgtcggactccgaggctaggacgaacgagctgacttatactgctnagctagtcgggacnccggctgaggtcggcggttggggttcggcgggttagggaccgaaggtcaacggccgtcgttacggtccncggaacccg

SEQ ID NO: 399018 - DNA, 514 bp, Homo sapiens
  misc_feature: GZ8MTXP01BR6RU.10.1.A01.1.454.CMB.2.raw
  modified_base (317)..(317): a, c, t, g, unknown or other
  modified_base (360)..(360): a, c, t, g, unknown or other
  modified_base (364)..(364): a, c, t, g, unknown or other
  modified_base (366)..(366): a, c, t, g, unknown or other
  modified_base (371)..(371): a, c, t, g, unknown or other
  modified_base (390)..(390): a, c, t, g, unknown or other
  modified_base (430)..(430): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctnagggatcctcagagacgattctctgcatccaggtcagggaacncacncncctcnaccatacgcgactcgagcngacgacgagctagtattatactgctcgagctagcggaccnccggtctcgttggtcggttcgggttcggggtttcggcgggacgggaccgaagtcgtcggaccgtacgttacggtcgaacgcccg

SEQ ID NO: 399019 - DNA, 664 bp, Homo sapiens
  misc_feature: GZ8MTXP01BL4LX.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgttgctgcagcagcaccgaggcccaccctccaagcctcctctaccgacaggaactaacactccggccctcgagggactccgtcaggacgagtacttctctgctacgtaccgagggtcaagggacgccaccgtaacgccccttacccgtacggtaacccctagtttaacccgtacgggtaaaccttcccgagggttacctagggaacccgtaaacggaaacggggccctttaaggtaactttaaacgtttaaccgtcggtccttacgtaaccggcgtaacggtacggggtaacccaacccggggtcctacggttacggggttcggttcggggtttacggggttttaccgggacggggttacgggacccgaaggtcgtccggtaacccggtccgttacgggtccgaacggtaaccccgg

SEQ ID NO: 399020 - DNA, 749 bp, Homo sapiens
  misc_feature: GZ8MTXP01DKGSP.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtagggaaacaacaaacaatgttcggaccacggacggagtcgtttggctgcagcagcaccgacggcccacccctcccaacgcctcccgtctacccgacaacggaaactaaaccacgtcccggcccctagacggggtacttcccacgaagagtacgtaacttcctactcggactaacgttacccgaaggggtacccaagggggaaacgacccaaccgtaacccggtcccctttacccccgacggtaaaccccttaacgttttaaaccccggtcggggtaaccctttaccccggaacggggaccttaaacgggaaaccgggaaacccggtaaagggggtccctttaaacgggttaaattttaacgttaaaccgttcggaccgttaaccaacggtacgtaacggttccgggggaaaaccctccccgggtaacctacggttaacgggttcggttccggggtttcgggggtttccggacggggttcgggaaccgaagtcgtaacggtacccgtacgttacggtcgaaccgtaaccccgg

SEQ ID NO: 399021 - DNA, 576 bp, Homo sapiens
  misc_feature: GZ8MTXP01ENQPD.10.1.A01.1.454.CMB.2.raw
  modified_base (289)..(289): a, c, t, g, unknown or other
  modified_base (313)..(313): a, c, t, g, unknown or other
  modified_base (328)..(328): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggcccaccctccaagctctcnccacagaactaacactccggcctnaggactcctcagtanagacttctctgcatccaggtcagaagcacacgccctccgacacctattacctcggactcgacgcgtacgaacgaccgaaagtcgtagtaactttaactacttcgactcgacgctaacgtcgggaacccgaccggtccctacgttacggtcgggttcgggtttcggggtttccggggacggggttacgggaaccccgaaggtccgtaacgtacccgtacccggttacggtaacccgaacggaaccccgg

SEQ ID NO: 399022 - DNA, 641 bp, Homo sapiens
  misc_feature: GZ8MTXP01CX1LE.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactaggaacaacaacaatgtgcacgacggagtcgttgctgcagcacgcaccgacggccccacccctcccaacgcctccctccgtaccgaacaacggaaactaaccacgtcccggccctacgacgggactcccgtacgacgagacgtacttactctcgctaacgtcccgagggtcgaacggaacgaccacgaccgtacccctcccgtagaaccctaacttacgtacgggactcccgagtccacggaacgtaacgaagtcgttaagttaactttacgttactacgtcgtacgaacgcgtaacgggtccggaccgtacccggtctcggacggttcgggttcgggtttacgggggtttcgggacgggttacgggacccgtaacggtccgtccggtaacccggttcgttacggtcccgaacgtaaccccggg

SEQ ID NO: 399023 - DNA, 655 bp, Homo sapiens
  misc_feature: GZ8MTXP01C0GIV.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactaggaacaacaacaatgtgccacgacggtagtcgttggctgcagcagcaccgagggcccacccctcccaacgcctccctacctaccgaaccaacggaaactaaccacgtccccggacccttacgaaggggtactacccgtaccgaagagaacgactttctacgtcgactacgtacccgtaacggtacgaacggggaaacgacccacgaccggccctacccctacgacctacgttaaccgtcggacctacccgaggtcctacggaaccgaacgtaagggtcctagttaactttacgttaacgtcgtactacgaacgctacggtacgggaccctacccgggcctcgttaggttcggcggggtttcgggtttcgggaccgggttcgggaaccgaacggtccgtaacggtacccggtacgttacggtccgaacggaaccccgg

SEQ ID NO: 399024 - DNA, 688 bp, Homo sapiens
  misc_feature: GZ8MTXP01AS9WR.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttggccacggacggagtcgttgctgcagcagcaccgacggcccacccctcccaacgcctccctcgtaccgacgaacggaaactaaccgacgtcccggacccgtacgacggggacttccccgtaccgaggacgaacggtactttaccctcgttcggacctacgttacccgagggttaccgaaggggtacgaccgaccgacgtcccctacccgtacggacccttaagtttaccgcgggtacctccgaggtctacggaacgacgaacggtctaggtaactttactacgtcgtactacacggctaacgggtcggacccgtacccgggtcttacggttaggggttccggttacgggggttttgggggtttcccgggaacgggggttacggggaaccccgttaagggtccgttaaccggggtaacccgtcggggttaacgtccggaaccggtaaccccggg

SEQ ID NO: 399025 - DNA, 708 bp, Homo sapiens
  misc_feature: GZ8MTXP01C84E0.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacacgaccgccacactcacctgcactggaacaacaacaatgtgcacgacggagtcgttggctgcagcagcaccgacggcccaccctccaacgcctccctctaccgacgaggaaactaaccacgtcccggccctacgacggggtactccctaccagagacgtactttcctctcggctaacgtacccgacgggtacgaacgggaaacgaccaaccgacgtaccccgttaccccgtacggtaaccctaacgtttaaccgtcggggtaacccttaccggacggggtacctacggaaacggtaaccggaaacggggttcctttaaggttaaactttacgtttaacgtcgtaccttaccgaacgtaccgtacggtaccggggaaccgtaccccgggccttccgacgggttcggggttcgggtttacgggggttttcgggaccggggacggggttaaccgtaaacggtccggtaacccgttacccgggtaccgttaacgggttcccgaaacccggtaacccgg

SEQ ID NO: 399026 - DNA, 751 bp, Homo sapiens
  misc_feature: GZ8MTXP01CQ0IH.10.1.A01.1.454.CMB.2.raw
  modified_base (280)..(280): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactgggaacaacaacaatgttggccacgacggagtcgttggctgcagcagcaccgacggcccaccccnccaacgcctcctctccgacacggaactaacactcccggaccctacgagggactcccgtacagagtacgactttccgtctcggcctaacgtcccggtacggtacgaacggggaaacgcccaacgaccgtcccctacccgtacggtaaccctactttaaccgtacgggacccttacccggacggtaccgttaacggaacggtaaccggtaaagggtcccgttaaggttaacttttaaacgttaccgtttaccgaccgtttacgaaacggtccgtaacggttacgggggaaaccccgtaccccggggtaacccttaaccggttaacggggtttccgggttccgggggttttaccggggggtttttacccgggggaaccgggggttaacgggggttaccccgtaaacggggtcccgtttaacgggaccccggtttaccggttacgggttaacccggaacccggtaacccccgggg

SEQ ID NO: 399027 - DNA, 687 bp, Homo sapiens
  misc_feature: GZ8MTXP01EXYGE.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccacccgtcggtactccaaggcttagagacacgacccgccacacctccacctgaccaacgtacgggaaacaacaaacagtggttcggaccgaacggacggtacgttcgtttggctgcagcacgccaccgacgggaccccacccctacccgaacgtcctccctccgtaccgaacgaacggaactaaccgaccgttcccggccctacgcgggtactccccgtacgagagtacgtacttctcgtcgactaacgtccgacggacaacgggaaaccaccgaccgtaccgtacccgtaccgtaccgtaccgtacgtaccgaacgtaccgtaccggacggtacgtaacggaacgaacgtacggtcgtacgttacttacgttacgtcgtacgtacgacgtacgtacggtaccggaccggtcccggtccgtcggttacgggtcgggttcgggttcggggttcgaacgggggacccgacggaacgtcgtaacccggtacccggtacggttaccgtaacggccccgaacggg

SEQ ID NO: 399028 - DNA, 772 bp, Homo sapiens
  misc_feature: GZ8MTXP01AHE0L.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtgccacgacggagtcgttggctgcagcagccaccgacggcccaccctcccaagcctcctcctccgaacaggaaactaaccgacgtcccggaccctacgacggggacttccccgtacgaaggtaacggtaacgtaactttcccgtaccgttcggaccctaaacgttaccccggaaaggggttacccgaaacgggggaaacgacccgaacccgtaacccggtacccccttaccccgtaccggtaaccccttaacgtttaacccgtaccgggtaaccttaccccgacggtaccgtacggaaccggtaaccgaacggggtaccgtaggtaacttttaacgttaaccgttcggtcctacgtaacggaccgttaacgggtaccggggaacccgtaccccggggtaacccgtacggttacggggttcgggttaccgggttttcggggggttttaccggggaccggggttaacggggttaacccggaacggtccgtaaccgggtacccggtacccggttacgggttaacccgaacggtaacccccggg

SEQ ID NO: 399029 - DNA, 544 bp, Homo sapiens
  misc_feature: GZ8MTXP01EDNB1.10.1.A01.1.454.CMB.2.raw
  modified_base (346)..(346): a, c, t, g, unknown or other
  modified_base (380)..(380): a, c, t, g, unknown or other
  modified_base (424)..(424): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccgaggcccaccctcccaagcctccctctccgacaggaactaacactccggccctgagggactccctcagagagtacttcnctgcatccgaggtcaggaagcacacgccctaccngaccattacgtgactcgagctgacgacgaaggctgtattatacngctcaagctagtcgggaccaccggtcctacgaggtcggttcggttcggggtttcgggacgggttacgggaccgtaacggtcgtcgacccggtaccgttacggtccgaacggtaaccccgg

SEQ ID NO: 399030 - DNA, 698 bp, Homo sapiens
  misc_feature: GZ8MTXP01BHFQ3.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacacgaccgccacactcacctgcacgtagggaacaacaacaatgttggccacggacggagtcgttggctgcagcagcaccgacggcccaccctcccaacgcctccctctaccgacaggaactaacacgtcccggccctacgacgggactccctacgaggacgagtacttcctctgccacgtacccgaggtaccgagggaaacgaccacgtacgtccctaccctacgaaccctagtttaccgcgggtaacccttccggaaggtacctacggaaaccggtaaccggtaaaacgggtcgtttaacggtaaacttttaacgttaaccgttcgggaccctttacggaaacggttccaaacgggttaccgggggaacccctaaccccggggtcctacccgggttaagggggttccgggttaaccggggttttcgggggtttcgggacccgggggttacgggaccgaaggtcgtaacggtacccgtacgttaacggtcgaacggtaaccccgg

SEQ ID NO: 399031 - DNA, 609 bp, Homo sapiens
  misc_feature: GZ8MTXP01BD5EW.10.1.A01.1.454.CMB.2.raw
  modified_base (395)..(395): a, c, t, g, unknown or other
  modified_base (405)..(405): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctacagtgtcagtggtccaggcagggctgactcagccaccctcggtatccaaggacttgagacagaccgccacactcacctgcactaggaacaacaacatgtaggaccacgacggagtcgttggctgcagcagcaccgacggcccacccctcccaacgcctcctcctaccgaacgaggaaactaacccaacgtcccggccctacgaacgggactccgtacccgaggagagtacttctctgctactccgaggtacaaggacgcacncgccctccanacctattacgtcgacctccgaggtctagaaccgagtaacgcgtagtaactttatactgacctacgtagaccgtagtacgggacccacccggtcgtaaccgtaggttcgggtacgggtttcggggtttacggaccgggttaacgggccaacggtcctacgggtaacccgtcggtacgggttacctaaccgggcccgtaaccgggg

SEQ ID NO: 399032 - DNA, 542 bp, Homo sapiens
  misc_feature: GZ8MTXP01CUM2M.10.1.A01.1.454.CMB.2.raw
  modified_base (370)..(370): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggcccaccctcccaacgcctccctctccgacaggaactaacactcccggccctcgaggggactccctcagagagtacttcctctgcactccaggtcaggancacacgtccctcctcgacctattacgtcggacctccgacgctgacgacgaaggctagtattacttactcgctcgagctagtcgggaccaccggctcgaggtcgttcggttggggtttcggcgggttacgggaccgaagcgtcggaccgtcgttacgtccgaacgtaacccgg

SEQ ID NO: 399033 - DNA, 771 bp, Homo sapiens
  misc_feature: GZ8MTXP01D9653.10.1.A01.1.454.CMB.2.raw
  modified_base (229)..(229): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacagaccgccacactcacctgcactaggaacaacaanaatgttcgccacgacggagtcgttgctgcagcagcaccgaggcccacccctcccaagcctccctctaccgacaaggaactaaaccacgttccccggccctacgacggggacttaccccgtaccgaaggacgtacgtacttttaacctccgttcggcctaaacgttccccgtaaggggttaccaaacgggggtaaacgacccaacccgtaaccggtccccttacccccgtacggtaaccccctaaagttttaaccccgtacggggtaacccttaccccggaacggggacccgttaacgggaaaccggaaccgggtaaacggggtacccgtttaaagggttaaaccttttaaacgtttaaccgtacggtaccttaccgtaacggtacgtaacggttaccggggtaacccgaccccgggtaacccttacggttacgggttcgggttccggggtttacgggggttttccgggaccggggttaacgggacccgtaagggtccgtaacggtacccggtccggttacggtaaccgaacgtaaccccggg

SEQ ID NO: 399034 - DNA, 576 bp, Homo sapiens
  misc_feature: GZ8MTXP01AINTJ.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttgctgcagcagcaccgagggcccacccctcccaagcctccctctaccgacaggaaataaccacgtcccggccctacgaggggactccctacagagacgtattcgctgctactccgagggtacagggaacgcaacacgccctacccgtagaaccctattacgcggaccttcccgagggcctaggacgaccgaagtctagtattattactgctcacgtcagtacgggacaccgggctcgaggtcggttcggttcggggtttcggacggggttcgggacccgtaaggtccgtaacggcccgtcgttacgggtaaccgaacggtaaccccgg

SEQ ID NO: 399035 - DNA, 828 bp, Homo sapiens
  misc_feature: GZ8MTXP01BD55K.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccgaaggacttgagacacgaccgccacactcacctgcactaggaacaacaacaatgtgcacgacggtagtcgttgctgcagcagcaccgacggcccacccctcccaacgcctccctaccgtaccgacgaacggaaactaaccgacgtcccggacccctacgaacggggtactccctacgaacggacggtaacgtactttccgtacctcggacctaacgtacccgtaacgggttaccgaaacggggaacgaccgaacctaccgggtaccccttaaccccgtacggtaaaccccttaaagttttaaccccggtcgggggtaaacccctttaccccgggaaacggggtacccgttaaaccgggtaaacccgggaaaccggggtaaaacggggtacccgttttaagggttaaactttttaaaccgtttaacccgtttacggaccccgtttaacgtaaaccgggccgtttaaaccggggtaccgggggaaccccggtaaaccccgggttccccgttaacgggttacggggttccggggttacgggggtttccgggggttttaccggggaccgggggttacgggttaaacccgaagggtaccggttaaccggacccggttacgttaccgggttaaccgaacccgggtaaccccgg

SEQ ID NO: 399036 - DNA, 610 bp, Homo sapiens
  misc_feature: GZ8MTXP01AXN72.10.1.A01.1.454.CMB.2.raw
  modified_base (230)..(230): a, c, t, g, unknown or other
  modified_base (425)..(425): a, c, t, g, unknown or other
  modified_base (438)..(438): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacacgaccgccacactcacctgcactaggaacaacaanatgtcgcacgacggtagtcgttgctgcagcagccaccgacggccccacccctcccaacgtcctaccctaccgtacccgacgaacggtaaactaaccgaccgtcccggaccctacggacggggtactcccgtacgaggacgagtactttaccgtactcggactacgttacccgaggtacgaacggaacgacaaccncgtcccctaccgngtaaccctatttaccgacgtacctcgacggctacgacgaacgaggtcgtagtaacttacgtactgactcgagcgtagtacggactcggctagcggttcgcgggttgggttccgggaggttcggacccaaggtccgtcgtacccggtacgttaggtcccgaacgtaaccccgg

SEQ ID NO: 399037 - DNA, 594 bp, Homo sapiens
  misc_feature: GZ8MTXP01D7GIU.10.1.A01.1.454.CMB.2.raw
  modified_base (423)..(423): a, c, t, g, unknown or other
  modified_base (498)..(498): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccacctcggtatccgaaggacttgagacacgaccgccacactcacctgcacgtaggaacaacaacaatgttcggaccacgacggagtcgttggctgcagcacgccaccgacggcccacccctcccaacgcctcctcgtaccgacaggaactaacgacgtcccggaccctacgaggactccgaccgagacgagtacttcctctcgactactccgaggtacaaggaacgcacacgtccctacccgcaacctattaccgnggtactccgaggctagaacgacgaggtctagtattactactcgctcagtctcggtacggaccaccggtcctacgngggttcggttcgggttcggggtttaccggacgggttacgggaccgtaacggcccgtcggtacccgttcggttaacgtcccgaaccgtaaccccggg

SEQ ID NO: 399038 - DNA, 578 bp, Homo sapiens
  misc_feature: GZ8MTXP01C9G3P.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagccaccgacgggcccacccctccccaacgcctccctcctccgacaggaactaacacgtcccggaccctcagggactccctcagagagacttctctcgcactccgaggtcaggaacgcacacgccctcccgtagaacctattaccgtaggacctccgacggctacgaacgacgaacggtcttgtaactttagtactcgctcagtccaagtcgggacctaccgggcctcgaggttcggttcgggtttcggggtttcggggacgggcggggttaccgaaggtcgtaacggtcccgtccggttaggtccgcggtaaccccg

SEQ ID NO: 399039 - DNA, 719 bp, Homo sapiens
  misc_feature: GZ8MTXP01A577B.10.1.A01.1.454.CMB.2.raw
  modified_base (318)..(318): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgcccaccctcggtatccaaggacttgagacacgaccgccacactcacctgacactaggaaacaacaacatgtcggccacggacggagtcgttggctgcagcagccaccgacggccccaccctcccaagcctcctctaccgacaggaactaacncgtcccggcctacgagggactccgtacagagtagtacttctctgacacgttcccgaaggtaccgaagggaacacccgaaccgtacggtcccccttacccgtacggtaaccccttaacgtttaacccggtacgggttaccctaccgggacgggttacccgtacgggaaaccgtaaccggaaacggttccgtttaaggttaaactttaacgtttaaccgtcgtaccgttcgaaaccggtacgtaacgggttaccggggaaacccgtaacccgggcccttaacgggttacgggttcggggttccggggtttaccggggggtttccgggaacgggggttaccgggaccgtaacgggtccgtaacggtacccggttacgttacgggtccgaaccggtaaccccggg

SEQ ID NO: 399040 - DNA, 646 bp, Homo sapiens
  misc_feature: GZ8MTXP01AJ985.10.1.A01.1.454.CMB.2.raw
  modified_base (364)..(364): a, c, t, g, unknown or other
  modified_base (372)..(372): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagcccacctcggtatccaaggacttgagacacgaccgccacactcacctgacacgtagggaaacaacaaacatggttcggaccacggacggagtcgttagctagcagcacgccaccgacgggccccaccccgtccaacgcctcctctaccgacaggaaactaaccactccggacctgagggactccacagagtacgattcnctgctacncgaggtccaggaacgcaacgtcgccctaccctagaaccctagtttacccgaggtacccttaccggacggtacctaacgggaccgtaacggaaacggtccgtaagttagtttaaacttaccggtactcgtacgtaacgccgtaacggttccggggaacccgtaccccgggtctacggttacgggttccggttcggggttacgggggtttcccgggcggggttaacggaccgtaacgtcgtaaccgcccgtcggttacgtccgaacgtaaccccgg

SEQ ID NO: 399041 - DNA, 619 bp, Homo sapiens
  misc_feature: GZ8MTXP01BHZIJ.10.1.A01.1.454.CMB.2.raw
  modified_base (228)..(228): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactggaacaacaanatgtgcacgacggagtcgttggctgcagcagccaccgagggcccacccctccaacgcctccctcaccgacaggaactaacacgtccgcctcgaggctccgtacagagagtattctctcgcactccgaggtcgaggaacgaccacgaacgtccctaccctacgacctagtttaccgcgggtacctccgagggtacctaggaaccgaaccggaaggtcgttaaggtaactttaacttaacgtcggtacttacgaacgtaccgtacggttaccgggggaaccctaccccggggtccttcgggaacgggttccggttcgggttcgggggtttacgggacggggttacgggaaccgtaacgacgtcggacccgtcgacgggtccgaacgaacccgg

SEQ ID NO: 399042 - DNA, 620 bp, Homo sapiens
  misc_feature: GZ8MTXP01CRNWN.10.1.A01.1.454.CMB.2.raw
  modified_base (258)..(258): a, c, t, g, unknown or other
tcagcatagtagtgcacgaccggtgctcgatttagacgtctcatcaggggtccaaacagagcttcagcaagcatagtgggaatctgcaccatgccctgggctctgctcctccttaccctcctcactcactctgcagtgtcagtggtccaggcagggctgactcagccacctcggtatccaaggacttgagacagaccgcacactcacctgcactgggaaacaacaacaatgttcggaccacgacggtagtcgttggcngcagcagcaccgacggccaccctccaagcctcctctaccgaacaggaactaacactccggccctcgacgggactctcccgaagagacgtattcctctcgccaagtcccgaacgggtcaaacgggacgacacacgtccctcctacgacccattacgtacgaccttaccgagggtcacgacgtaacgaagtcgtagtaattacttaacgtcgtctacgacgtaccgacgtacgggaccgacccggtcctaacgtacggttcgggtcgggttccggggttttacgggaccggttacggggttaccccgaggtcccgtacggtaacccggttacctacgggttaccgtaacgccccgtaacccggg

SEQ ID NO: 399043 - DNA, 715 bp, Homo sapiens
  misc_feature: GZ8MTXP01EYIZ5.10.1.A01.1.454.CMB.2.raw
tcagcatagtagtgcacgaccggtgctcgatttagacgtctcatcagggggtccaaacagagcttcagcaagcatagtgggaatctgcaccatgccctgggctctgctcctcctgaccctcctcactcactctgcagtgtcagtggtccaggcagggctgactcacgccacccgtcggtactaccgaaggtacttgaacgacacgaccgaccacacctcacctgacacgtaggaaacaacaaactaagtcggttacggaccgaacggtacggtagttcggttcggctggcgacgacgacgaccgacccgaccggaccccaccccacccgaactccgtccctaccgtaccgacgaaacggtaaacctaacctaccggtcccggaccgtacggacggtactacccgtacgacgtaagagttaccttcgtactcggacctacgtaaccggtacgggaaccgaaaggacgtaccacgaccgtcccttaaccggtataaccctacgttacgacggtaaccctcggaaggccgaaacggacgttaacgacgtacgttagtaacttagttaccgctaccgagtaacgtcgtaaggacccggacggaccccgtaagtaccggttggggtccgttacgggggtttaggggtacccgggagggttccggaacgtaaccggtcgtaacccggttcgacggttaccgaacggttaacccgaaccggg

SEQ ID NO: 399044 - DNA, 591 bp, Homo sapiens
  misc_feature: GZ8MTXP01DJW1H.10.1.A01.1.454.CMB.2.raw
  modified_base (276)..(276): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactaggaacaacaacaatgtcgcacgacggagtcgttggctgcagcagcaccagggcccacccnccaagcctcctctcgacagtaactaacactccgcctacgaggacttcccacgtagagtacgtacttacctccgttgacacgttacccggagggtaccaagggacgaccaccacgtcccttacccgcgaacctacgttaacgtcggacctacgacggttccaggaaccgaccgtaagcttaggtaactttaacgtactcgtccagtacgactagtcgggaccaccgggctcgaacggtgttacgggttcgggtttcgggacgggttacggacgtaaggttccgcgtaccgtcgttacgggtcaaccggtaacccgg

SEQ ID NO: 399045 - DNA, 546 bp, Homo sapiens
  misc_feature: GZ8MTXP01BBP8Z.10.1.A01.1.454.CMB.2.raw
  modified_base (290)..(290): a, c, t, g, unknown or other
tcagcatagtagtgcacgaccggtgctcgatttagacgtctcatcagggggtccaaacagagcttcagcaagcatagtgggaatctgcaccatgccctgggctctgctcctcctgaccctcctcactcactctgcagtgtcagtggtccaggcagtgctgactcagccaccctcggtatccaaggacttgagacagaccgcacactcacctgcactggaacaacaacaatgtggccacgacgagtcgtgctgcagcagcacacgggccaccctccaagctcctctccganaggaactaacactccggcctcagggactctcagagagaattctctgacatccaggtacgacgggaaacacacacgtcctccgtacactatacgacgtacacgagacgtacgaacgaacggaacgtctagtaacttactacgtgtctacacgtacgacgtacggaccgaaccgtcgttcgtacggttcggtcgggttcgggttcgggttcgggacgggaacgacgtcgtcgtaccggttaccgtaacgttcgtaacg

SEQ ID NO: 399046 - DNA, 488 bp, Homo sapiens
  misc_feature: GZ8MTXP02FZHJ5.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccaggccaccctcccaagctcctctccgacaggaataacatccggccctcagggatcctcagagagattctctgcatccaggtcaggagcacagccctccctgaccattactggactccagctgacgacgaagctgattatactgctcagcatgggacaccggctcagtcgcgtgggtttcggcggagggaccaagctcgaccgtccgtaggtcacgacccg

SEQ ID NO: 399047 - DNA, 536 bp, Homo sapiens
  misc_feature: GZ8MTXP02HCN3Y.10.1.A01.1.454.CMB.2.raw
  modified_base (378)..(378): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcacaggccaccctccaagcctcctctccgacaggaactaacatccccggccctcgaggggactccctacagagagattctctgcactccgaggtccaggacgcacagccctcccngaccattactcgactcaggctgacgacgaagctagattatactgctcagcagtcgggacacccggctacgagtcggtcggttcggggtttcggacggggacgggaccgaacggtccgtacggtacccgttaccggtaacggttccgacggaaccccgg

SEQ ID NO: 399048 - DNA, 615 bp, Homo sapiens
  misc_feature: GZ8MTXP02IKMAZ.10.1.A01.1.454.CMB.2.raw
  modified_base (359)..(359): a, c, t, g, unknown or other
  modified_base (380)..(380): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtgggaacaacaacaatgttggccacggacggagtcgttggctgcagcagcaccgagggcccaccctcccaacgcctccctcctccgaacaggaaactaaacactcccggccctacgacgggacttcccacaagagagtattcnctgcatcccagtccaggaacncacacgccctccctacgacctattacgtcggtacctaccgacggcctacggaaccgaaacggaacgaccgttagtaatttaacgttaactcgtaccgttacaacggcccttaagtacggggaacccgaacccgggtccctacgtacggtcgtcgggtttcgggggttttaccgggacgggtaacgggaccgaaaggtcgtacggtaccgtaccgtacggtaccgacggaccccgg

SEQ ID NO: 399049 - DNA, 502 bp, Homo sapiens
  misc_feature: GZ8MTXP02GCYBX.10.1.A01.1.454.CMB.2.raw
  modified_base (339)..(339): a, c, t, g, unknown or other
  modified_base (414)..(414): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccaggccaccctccaagcctcctctccgacaggaataacatcccggccctcagggactcctcagagagattcnctgcatccagtcaggaagcacagccctccctgaccatactggactccgagctgacgacgaagctgtattattacngctcagcatgggacaccggcctcagtcgcggtcgggtttcggcggtacggaccaaggcgtacgaccgtccgtacggtcgacgacccgg

SEQ ID NO: 399050 - DNA, 541 bp, Homo sapiens
  misc_feature: GZ8MTXP02IC2XN.10.1.A01.1.454.CMB.2.raw
  modified_base (288)..(288): a, c, t, g, unknown or other
  modified_base (362)..(362): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccagacggagtcgttggctgcagcagcaccaggcccaccctccaagctccctcnccgacaggaataacatcccggccctcgagggatccctcagagagtattctctgctatcccagtccagggaaacncacacgcctcctcacctacttacgtacgtacctacgacgctacgacgacgagactagtattatactcgactcgacgcgagtacggaccgaccgtcgtcgtacggtcggtcggttcggggttcggacgggtacggaccgtaacgtcgtacgtaccggtaccgtacggtaccgacggaccg

SEQ ID NO: 399051 - DNA, 611 bp, Homo sapiens
  misc_feature: GZ8MTXP02H231H.10.1.A01.1.454.CMB.2.raw
  modified_base (372)..(372): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctcgaccctcctcactcactctgcagtgtcagtggtccaggcagggctgactcagccaccctcggtatccaaggacttgagacagaccgccacactcacctgcactggaacaacaacaatgtgcacgacggagtcgttggctgcagcagcaccgacggccacccctccaagcctcctctccgaacaggaataacactcccggccctgagggactcctacagacgagattctctgcaacttcccgaggtaccaagggaaacnccaacgacgccctccctacgaaccctaatttaaccgcggtacctacccgagggcctacggaaaccgaacgaaagccgttagtaactttaattaaccttgcctacgagccaaagtcgggggaacctaacccggggcctttaaccgggtacggttcggtacggggtttcggggtttaccggggacgggtaacgggaccgtaacggtccgtacggtaccggtacgtacggtacgaccgaccg

SEQ ID NO: 399052 - DNA, 518 bp, Homo sapiens
  misc_feature: GZ8MTXP02H9NYE.10.1.A01.1.454.CMB.2.raw
  modified_base (361)..(361): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctctcactcactctgcagtgtcagtggtccaggcagggctgactcagccacctcgtatccaaggacttgagacagaccgccacactcacctgcactgggaacaacaacaatgttggccacgacggagtcgtttggctgcagcagcaccagggccaccctccaagctcctctccgacaggaataacatcccggccctacgacggggatccctcagagagtattctactgcatccaggtcaggaancacagcctccctgaccattactggactccagctagacgacgaagctagattatactgactcagcaagtcgggacaccggctacgaggtcgcggttcgggtttccgggacgggtacggaccgaagtcgtacgaccgtccgttacggacgacgacccgg

SEQ ID NO: 399053 - DNA, 512 bp, Homo sapiens
  misc_feature: GZ8MTXP02H1LJT.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagcaccaggccaccctcccaagcctcctctccgacaggaataacatcccggcctcagggactcctcagagagattctctgcatccagtcaggaagcacacgccctccctcgaccattactcggactccagctagacgacgaagctagtattattactgctacagcagtcggacaccggcctcgagtcgtcggtcgggtttcggacgggtacggaccgaaggcgtacgaccgtaccgtacggtcgacgacccg

SEQ ID NO: 399054 - DNA, 510 bp, Homo sapiens
  misc_feature: GZ8MTXP02F15F7.10.1.A01.1.454.CMB.2.raw
  modified_base (374)..(374): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccaggccaccctccaagctcctctccgacaggaataacatccggcctcagggatcctcagagagattctctgcatccaggtcaggagcacagccctcctagacctatacncggactcgaggctgacgacaagctagattatactgctcagcagtcgggacacccggtctcgtagtcggtacggttcggggtttcggacgggagggacccaaaggcgtacgacccgtcgtaacggccacggtacccg

SEQ ID NO: 399055 - DNA, 520 bp, Homo sapiens
  misc_feature: GZ8MTXP02HKKDU.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccacccctcccaagcctcctctccgacaggaataacatcccggccctcgagggactcctcagagagattctctgcatccagtcaggaagcacacgccctcctgaccattactggactccagctgacgacgagctgattagtactgctcagcagtcgaacaccggcctcgacgtcgtccggttggggttttccgggcggggtacggtaccgaacggtcgtacggacccgtcgtaacgtcgacgacccgg

SEQ ID NO: 399056 - DNA, 514 bp, Homo sapiens
  misc_feature: GZ8MTXP02I2SWH.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctccaagcctcctctccgacaggaatacatccggcctcaggatcctcagagagatctctgcatccaggtcaggagcacacgcctccctgacctattactcggactcgacggctgacgacgaagctagattatactgctacagcagtacgggacaccggcctacgagtcggtcggttcgggtttcggcgggtagggaccgaacggcgtacgaccggtaccgtacggtcgacgaaccccgg

SEQ ID NO: 399057 - DNA, 496 bp, Homo sapiens
  misc_feature: GZ8MTXP02IC43W.10.1.A01.1.454.CMB.2.raw
  modified_base (282)..(282): a, c, t, g, unknown or other
  modified_base (333)..(333): a, c, t, g, unknown or other
  modified_base (352)..(352): a, c, t, g, unknown or other
  modified_base (365)..(365): a, c, t, g, unknown or other
  modified_base (375)..(375): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactggaacaacaacaatgtggccacgacggagtcgttggctgcagcagcacaggccaccctcccaagccncctctccgacaggaataacatccggccctcagggatcctcagagagattcnctgcatccagtccaggaancacacgcctcccngaccattacngactccagctgacgagaagctgattataactgctcagcagtcgggacaccggcctcgagtcgtcggtcgggtttcggcggtagggaccaagcgtacggaccgtcgtacggtcacgacccgg

SEQ ID NO: 399058 - DNA, 546 bp, Homo sapiens
  misc_feature: GZ8MTXP02I4AL2.10.1.A01.1.454.CMB.2.raw
  modified_base (417)..(417): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttgccacgacggagtcgttggctgcagcagcaccaggccaccctccaagcctcctcctccgacagaactaacactccggcctcaggactcctcagagagattctctgcatccgagtcaggagcacacgcctcctacgacctattactcgactccgacgctagacgacgaagctagacttattacngtctacagcagtacggacacccggcctacgacggtcggtacggttcggggttttccgggacgggtaacggggaaccgtaaggtaccgtacggtacccggtaccgtacgggttaccgacggtaaccccgg

SEQ ID NO: 399059 - DNA, 493 bp, Homo sapiens
  misc_feature: GZ8MTXP02ISBJF.10.1.A01.1.454.CMB.2.raw
  modified_base (337)..(337): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaaaatgttggccacgacggagtcgttggctgcagcagcaccagggccaccctcccaagctcctctccgacaggaataacatcccggccctcagggatctccagagagattcnctgcatccaggtcaggaagcacagcctcctgaccattactgacctcaggctgacgacgagctcgattattactgctcagcatgggacaccggcctcgagtgcgttgggtttcggcggtacgggccaagcgtgaccgtcgtaggtcacgcccaacgg

SEQ ID NO: 399060 - DNA, 496 bp, Homo sapiens
  misc_feature: GZ8MTXP02F7JG4.10.1.A01.1.454.CMB.2.raw
  modified_base (373)..(373): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggccaccctccaagctcctctccgacaggaataacatccggcctcaggatcctcagagagattctctgcatccagtcaggagcacagcctccctgaccattacngactcagctgacgacgaagctgattattactgctcagcagtcggacaccggcctcaggtcgcggttcgggtttcggcgggtacgggaccgaagcgtcgaccgtccgtacggtccgacgacccg

SEQ ID NO: 399061 - DNA, 488 bp, Homo sapiens
  misc_feature: GZ8MTXP02FY06C.10.1.A01.1.454.CMB.2.raw
  modified_base (382)..(382): a, c, t, g, unknown or other
  modified_base (421)..(421): a, c, t, g, unknown or other
  modified_base (455)..(455): a, c, t, g, unknown or other
  modified_base (465)..(465): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaaatgttggccacgacggagtcgttggctgcagcagcaccagggccaccctccaagctcctctccgacaggaactaacatcccggcctcagggatcctacagagagattctctgcatccaggtcaggaagcacacgcctccctgaccatttacnggactccaggctgacgacaaagctgattataatgctcancatggacaccggctcagtgcgtgggtttcgcggnggacaagcgngacgtccgtaggtcacgaacccg

SEQ ID NO: 399062 - DNA, 505 bp, Homo sapiens
  misc_feature: GZ8MTXP02HG0V2.10.1.A01.1.454.CMB.2.raw
  modified_base (288)..(288): a, c, t, g, unknown or other
  modified_base (359)..(359): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggcacgacggagtcgttggctgcagcagcaccaggccaccctccaagcctcctcnccgacaggaactaacactcccggccctcgacgggactccctcagacgagattctctgcatccagtcaggancacacgcctccctgaccattactgactcagctgacgacgagctgattatactgctcagcagtcgggacaccggctcagtcgcggttcggggtttcgacgggacgggtaccaaggcgtacggaccgtccgtacggtcacggacccgg

SEQ ID NO: 399063 - DNA, 512 bp, Homo sapiens
  misc_feature: GZ8MTXP02FSA9T.10.1.A01.1.454.CMB.2.raw
  modified_base (380)..(380): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatcctcagagagattctctgcatccagtcaggaagcacagccctccctgacctattacnggactccgagctgacgacgaagctgattattactgctcagtcagtggacaccggcctcgagtcgtcggttggggtttcggacgggtacgggaccgaaggctacggacccgtccgtacggtccgacgacccgg

SEQ ID NO: 399064 - DNA, 491 bp, Homo sapiens
  misc_feature: GZ8MTXP02IYOAD.10.1.A01.1.454.CMB.2.raw
  modified_base (337)..(337): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccacccctccaagctcctctccgacaggaataacatcccggcctcgaggactcctcagagagattcnctgcatccagtcaggagcacagcctcctgaccatactcggactcaggctgacgacgaagctagattatactgctcagcagtcggacaccgctcgagtcgcgttcggtttcggcggtacggacgaagcgtacgaccgtcgtacggtcacgacccg

SEQ ID NO: 399065 - DNA, 573 bp, Homo sapiens
  misc_feature: GZ8MTXP02JI8BP.10.1.A01.1.454.CMB.2.raw
  modified_base (365)..(365): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggcccacccctccaagcctcctctccgacaggaactaacactcccggaccctcgagggactcctcagagagattctctgcatccgagtcaggaacncacgacgccctaccctgaccctattactcggaacttcccgaaggctacggaaccgaacgaaggtcctaggtaactttagttaactggcctacgagtcaggtacgggaccacccgggtctacgtggtcggtcgggttacggggtttcggacggggtacggtaccgaaggtccgtacggtaacccgtcgtacgggttacgacggaccccg

SEQ ID NO: 399066 - DNA, 476 bp, Homo sapiens
  misc_feature: GZ8MTXP02GF1GF.10.1.A01.1.454.CMB.2.raw
  modified_base (336)..(336): a, c, t, g, unknown or other
  modified_base (375)..(375): a, c, t, g, unknown or other
  modified_base (408)..(408): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccaggcccaccctccaagcctcctctccgacaggaactaacatccggcctcgaggatcctcagagagattcnctgcatcagtcagaagcacacgcctccctgaccattacncggactccagctgacgacgaagctgattatacngctcagcatcggacacgctcagtgtcgtgggttcgcggaggacaagctgccgtacacggtcacgaccg

SEQ ID NO: 399067 - DNA, 534 bp, Homo sapiens
  misc_feature: GZ8MTXP02GNJ9B.10.1.A01.1.454.CMB.2.raw
  modified_base (360)..(360): a, c, t, g, unknown or other
  modified_base (365)..(365): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgtttggctgcagcagcaccagggccacccctcccaagcctcctcctccgacaggaactaacatccgcctcagggatcctcagagagattctctgcatccagtcaggagcacncgccnccctgacccattactcggaactccgtagctacgacgacgaaagcgtagattagttactgctacagcagtacggacaccggctaccgagtcggtcggttcggggtttccgggacgggtacgggaccgaaggtcgtacggtaccgtccgttaacggccgacggaaccccgg

SEQ ID NO: 399068 - DNA, 571 bp, Homo sapiens
  misc_feature: GZ8MTXP02HO4KA.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccacgacggagtcgttggctgcagcagcaccaggccaccctccaagctcctctccgacaggaataacatccggcctaggagtctccacgagagagttactctgtcgactacctacgtacgtacgaacgacgaccacgacgtccctccgacgacttacgttacgtacgtacctacgacgtcgacgaacgaacgacgtctagtaatttactacgtactactacgacgactagggtaccggaaccgcccgtacgtacgtaggtcggtcgggtttcgggttacgggacggggtacgaacgaacgtcgtacgtaccgtacggttacgacgtaccgaacccgg

SEQ ID NO: 399069 - DNA, 734 bp, Homo sapiens
  misc_feature: GZ8MTXP02H7TRD.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactggaacaacaacaatgttggccacggacggagtcgttggctgcagcagcaccgacgggcccacccctcccgaagcctcccctactcccgaacaaggtaaactaaaccacgtcccggacccttacgacggggtaactcctaccgaaggaaggtacggtaacttttccgtccttgggcctaaacgtccccgtaaggggttaccaacggggaaaacgcccaaacccgacggccccttaccccgtacggaacccctaacgtttaaccgttcgggtaaccttacccgaacgggtccgttacggaaccggtaaaccggaaacggtccgttaggtaactttacgttaaacgttcggtacttaccgacgtacgtaacggttacgggaacccgaccccggtaccgtacgtaacgggttcgggtccggggtttcgggggttttacccgggacgggggttaacggggacccgtaaacggtccggttaccgggtaccggttaccgtaacgggttaccgaacggtaaccccgg

SEQ ID NO: 399070 - DNA, 523 bp, Homo sapiens
  misc_feature: GZ8MTXP02GYPZ1.10.1.A01.1.454.CMB.2.raw
  modified_base (339)..(339): a, c, t, g, unknown or other
  modified_base (357)..(357): a, c, t, g, unknown or other
  modified_base (414)..(414): a, c, t, g, unknown or other
  modified_base (435)..(435): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccacgacggagtcgttggctgcagcagcacaggccaccctccaagctcctctccgacaggaactacactcccggccctacgacgggatcctacgagagagattcnctgcatccgagtcaggancacacgcctcctgaccattactcggactcaggctgacgacgaagctgattatacgtnctacagtcagtacgggaaccnccgggcctcgaggtcggtcgggttcgggtttccgggacggtacgggaccgaaggtcgacggtaccgtcgtaacggtccgacgacccgg

SEQ ID NO: 399071 - DNA, 627 bp, Homo sapiens
  misc_feature: GZ8MTXP02GZZKJ.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcaccgaggcccacccctccaagcctcctcctccgacaggaactaacactcccggccctacgacgggactcctacaagagagtattcctactcgcactccgaggtccaagggaagccaacacgccctccctacgaaccctattacgacggtacctaccgaaggccgtacggaaacggacgtaaacgccgttagtaactttaacgttaactcggtacttaccgaagacgtagtacggggaaccgtaacccgggtcctaccggaacggtcggtcgggtttcgggggttttaccggggacggggttaaccggggaaccgaaacggtccgttacggacccggttaccggtacggtaccgacggtaaccccgg

SEQ ID NO: 399072 - DNA, 772 bp, Homo sapiens
  misc_feature: GZ8MTXP02IJNYY.10.1.A01.1.454.CMB.2.raw
  modified_base (418)..(418): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttggccacgacggagtcgttggctgcagcagcaccagggccacccctccaacgcctaccctcaccgacgacggaaactaaccgactccccggacccctacgaacggggacttcccctacgaacggacgtaagtactttacctcgtcgacctaacgtccccgaaaggggttaccaagggggaaacncccgaaaccgtaccggacccccttacccgtacggaacccttaaacgtttaacccgtacgggtaacccttacccgaacgggtaccgttaacggaaacccgggtaaaccgggaggtaccgttaaaggtaaactttaaacgttaacgtcgggtacctaacggtaccttaccggtaaattacggttaagttaaggtaacgtttacgggttaccgttaccttttaccggttttaaccggtttaaacgggggtttttacccggggaacgggggttaaccggggtaacccggttacgggtaccggttaccggtaaaccccggtttaccgttaaaaccggtttaccggtaaaacccccgggg

SEQ ID NO: 399073 - DNA, 584 bp, Homo sapiens
  misc_feature: GZ8MTXP02HBS5S.10.1.A01.1.454.CMB.2.raw
  modified_base (369)..(369): a, c, t, g, unknown or other
  modified_base (379)..(379): a, c, t, g, unknown or other
  modified_base (390)..(390): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtgccacgacggagtcgttggctgcagcagcaccagggcccaccctccaacgcctcctctccgacaggaactaacatcccggccctcgagggactcctccgagagacgattcgtctgcatcccaggtcaggacgcacncgccctcccncgaccattacncgtactaccgagctacgacgacgaagtccgtagtacttacttacgtcgccgttacacgacgtacgtacggggaacccacccggggtcctaccggtggttcggtccgggttcggggttttccggggacggggtacgggtaccgaaggtccggtacggtacccggttaccgtacggttaccgacggtaacccccgg

SEQ ID NO: 399074 - DNA, 568 bp, Homo sapiens
  misc_feature: GZ8MTXP02F6MHK.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtggaacaacaacaatgtgccacgacggagtcgttggctgcagcagcaccaggcccaccctccaacgcctacctcctccgacaggaactaacgactcccggccctcgaggggtactcccgtacagagacgtattcctctgcactccgagtacaaggaacgcaacacgccctaccctacgacctattacgtcggacctaccgaggtcacgaaccgacggaagtcgtagtattacttacgtgtactacacgcgtagtacgggacctacccggctcgaggtcggtcggttcggggtttccggacgggtacggaccgtaagtccgtacggtacccgtcgttacggccgacgacccgg

SEQ ID NO: 399075 - DNA, 520 bp, Homo sapiens
  misc_feature: GZ8MTXP02IHD9J.10.1.A01.1.454.CMB.2.raw
  modified_base (359)..(359): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcactgcactggaacaacaacaatgttgccagacggagtcgttgctgcagcagcaccagggcccaccctccaagcctacctctccgaacaggaataaaccatcccggccctcgaggggactcctcagacgagattctctgcatccagtcaggancacagcctcctgacctatactcggactcgacgctcgacgacgaagctgtattattactgctacagactagtacgggacaaccggtcctacgagtcggtcggttcggggttttcggcgggtacggaccgtaagcgtcgaccgtacgtacggtcacggacccg

SEQ ID NO: 399076 - DNA, 560 bp, Homo sapiens
  misc_feature: GZ8MTXP02G1SPU.10.1.A01.1.454.CMB.2.raw
  modified_base (365)..(365): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccaggccaccctccaagcctcctcctccgacaggaactaacactccccggcctcgagggactcctacagagacgattcctctgcactccgagtcaaggacncacacgccctccctcgaccattacctcggactccgagctcgacgacgaagctagtattattactcgtctacacgctagtcgggaccaccggtcctacgtaggtcggtcggttacgggggttttccgggacggggtacgggaaccgtaaggtaccgtacggtacccggttaccgtacggtaccgacggaaccccgg

SEQ ID NO: 399077 - DNA, 532 bp, Homo sapiens
  misc_feature: GZ8MTXP02JJCLX.10.1.A01.1.454.CMB.2.raw
  modified_base (342)..(342): a, c, t, g, unknown or other
  modified_base (362)..(362): a, c, t, g, unknown or other
  modified_base (385)..(385): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccgacgggccaccctcccaagcctcctctccgacaggaactaacatcccggccctcagggatccctcagagagattcnctgcatccgagtcaggaacncacgagccctcctgaccattacncggaactccgagctacgacgacgaagctagattatactgctcgagcagtcgggacacccggtctcgaggtcggcgggttgggtttccgggcgggacgggtaccgaagggtcgtacggacccgtccgtaacggtccgacggaacccgg

SEQ ID NO: 399078 - DNA, 607 bp, Homo sapiens
  misc_feature: GZ8MTXP02IRVB8.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactaggaacaacaacaatgtcgacacgacggagtcgttggctgcagcacgcaccgacggcccacccctccaacgcctcctcctccgacgaacggaaactaacacgtcccggccacgttttttaggactcctacagagagtattctctgcactccgacgtacgaaggacgacacacgcctcccacgacctacttaacgtcggtactccgacggacacggaacgaacgaacgtacgtacgtaatttacttaacgtcgactacgtacgacgacgtacgggacgacccggtaccgtcgtacggtcgggttcgggtttcggggtttacggggtacggggaacgggtaaccgaacggtacgtacggtacccggtaccgtacggtaccgacggaacccgg

SEQ ID NO: 399079 - DNA, 553 bp, Homo sapiens
  misc_feature: GZ8MTXP02JRMWO.10.1.A01.1.454.CMB.2.raw
  modified_base (345)..(345): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactagggaacaacaacaatgttcggccacgacggagtcgttggctgcagcagcaccgaggccaccctccaagctcctctccgacaggaactaacactccggcctcgagggactccgtacagagacgtattcnctgctatccgagtacaggaacacacgacgccctcccgtcgacctactacgtcgacctccgacggctacgaccgacgacgactagtacttattacgtcgtctacagcgagtacggaccgtaccggtacctcgacggtcggtcggttcgggtttcgggacgggtacggacgaacgtcgtacgtaccgtacgtacgtaccgtacgacccgg

SEQ ID NO: 399080 - DNA, 569 bp, Homo sapiens
  misc_feature: GZ8MTXP02GP9R8.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccacggccaccctccaagcctcctctccgacaggaactaacactcccggcctcacgggtactcccgtacagagagacttctctgcatccgagtcaggacgcacacgccctccctacgaccacttacgcggactccgacggctacgacgacgaagctgtacttacttactcgtactcgacgtcagtacgggaccgtaccggtcctaccgtacggttcggcggtttcggggtttaccgggaccgggtacggggaaccgaacggtcgtaccggtacccggtcccgtaacggtccgaacggtaccccgg

SEQ ID NO: 399081 - DNA, 524 bp, Homo sapiens
  misc_feature: GZ8MTXP02I9AW1.10.1.A01.1.454.CMB.2.raw
  modified_base (359)..(359): a, c, t, g, unknown or other
  modified_base (382)..(382): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccagggcccaccctccaagcctcctctccgacaggaataacatcccggccctcagggactcctcagagagattctctgcatccaggtcaggaancacagccctccctgaccattacncggactccagctgacgacgaagctgattagtactgctacagtcagtcgggacacccggcctcgacgtcgtcggttcgggtttccgggacgggaacgggtaccgaaggccgtacggacccggtccgtacggtcgacggacccg

SEQ ID NO: 399082 - DNA, 677 bp, Homo sapiens
  misc_feature: GZ8MTXP02IUD83.10.1.A01.1.454.CMB.2.raw
  modified_base (376)..(376): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacatgttgcacgacggagtcgttggctgcagcagcaccacggccaccctccaagcctcctctccgacaggaactaacactcccggaccctcgaagggactccctacgaagagacgtattccttactgacagtcccaagtccgaagggaacnccaacgacgaccctaccctacggaaccctaacgttaccgtacgggtaaccttacccggacgggaccgttacgggaaccggtaaaccggaaagtacccgttaggtaacttttaacttaaccgtcggtaccttacgacggtaccgaaggttaccggggaaacccgtaccccgggtaccgtaccggacgggtttccggttaccggggtttcgggggtttttaccggggaccggggtaacgggggtaacctaacgggtccgtacgggtaccccgttacggtacggttaccgaccggtaaccccgg

SEQ ID NO: 399083 - DNA, 498 bp, Homo sapiens
  misc_feature: GZ8MTXP02G93J8.10.1.A01.1.454.CMB.2.raw
  modified_base (326)..(326): a, c, t, g, unknown or other
  modified_base (333)..(333): a, c, t, g, unknown or other
  modified_base (350)..(350): a, c, t, g, unknown or other
  modified_base (363)..(363): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcaccaggccaccctcccaagctcctctccgacaggaataacatcccggccctcaggatcctcaganagattcnctgcatccagtcaggancacacgcctcccngaccatactcggactcgagctgacgacgaagctgattagtactgctcagcatgggacaccggctacgagtcgcggtcgggtttcggcggtacgggaccgtaagcgtacgaccgtaccgtacggtcgacgacccgg

SEQ ID NO: 399084 - DNA, 514 bp, Homo sapiens
  misc_feature: GZ8MTXP02FNA82.10.1.A01.1.454.CMB.2.raw
  modified_base (378)..(378): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatcccggccctcagggatcctcagagagattctctgcatccagtcaggagcacagccctcctgaccattacncggactccgagctgacgacgaagctagatttatactgctcagtcagtcgggacaccggcctacgagtcggcggttcggggtttcggacgggacgggaccaaggccgtacggacccgtcgtacggtcacggaccccg

SEQ ID NO: 399085 - DNA, 524 bp, Homo sapiens
  misc_feature: GZ8MTXP02HGUEM.10.1.A01.1.454.CMB.2.raw
  modified_base (364)..(364): a, c, t, g, unknown or other
  modified_base (395)..(395): a, c, t, g, unknown or other
  modified_base (404)..(404): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccaggccaccctccaagctcctctccgacaggaactaacactcccggccctcgagggactcctcagacgagacttctctgcatccgagtcaggacgcacncgccctcctcgaccattactcgactcagtcngacgacgancgtagattatactgctcgacgcagtcgggacacccgggacctcgtaggtcgtcgggttcgggtttcggacgggtacggaccgaacgtcgtacgaccgtacgtacggacgtacgaccccgg

SEQ ID NO: 399086 - DNA, 560 bp, Homo sapiens
  misc_feature: GZ8MTXP02HVHYF.10.1.A01.1.454.CMB.2.raw
  modified_base (350)..(350): a, c, t, g, unknown or other
  modified_base (370)..(370): a, c, t, g, unknown or other
  modified_base (374)..(374): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtaggaacaacaacaatgtggccacgacggagtcgttggctgcagcagcaccgacggccacccctccaagcctcctctccgaacaggaaataaacacgtcccggaccctcgaggactcctacgagagagtattcnctgcatccgagtcaggaacncacncgcctccacgacctattacgcgacctacgacgtcgagacgacgacgtctagtattactactcgctagacgacgacgtacggaccgaccggcctacgaggtcggtcgggttcggggttacgggaccgggtaacggaccgtaacgtaccgtacggtacccggtaccgtacggtaccgaaccggacccg

SEQ ID NO: 399087 - DNA, 525 bp, Homo sapiens
  misc_feature: GZ8MTXP02H6IRI.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctccaagctcctctccgacaggaataacatccggcctcagggatcctcagagagattctctgcatccagtcaggaagcacacgcctccctcgaccattactcggactccgacgctcgacgacgaagctagatacttactgctcagcagtcgggacaccggtcctcgacggtcgtcggtcggggttttcggggacgggtaggggaccgaaggcgtacggtaccggtccgtacggtccgacggaccccgg

SEQ ID NO: 399088 - DNA, 528 bp, Homo sapiens
  misc_feature: GZ8MTXP02G03CV.10.1.A01.1.454.CMB.2.raw
  modified_base (336)..(336): a, c, t, g, unknown or other
  modified_base (358)..(358): a, c, t, g, unknown or other
  modified_base (365)..(365): a, c, t, g, unknown or other
  modified_base (375)..(375): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgtggcacgacggagtcgttggctgcagcagcaccagggccaccctccaagctcctctccgacaggaataaccatcccggcctcagggactcctcagagagattcnctgcatccagtcaggacgcacngcctccngaccattacngactcagctgacgacgtaagctagattatactgctcagcagtacgggaccgaccggtcctcgacggttcggtacggttcggggtttaccgggacggggtacgggaaccgaaggccgtacggaccgttaccgtacggttccgacggtaccccgg

SEQ ID NO: 399089 - DNA, 546 bp, Homo sapiens
  misc_feature: GZ8MTXP02H859S.10.1.A01.1.454.CMB.2.raw
  modified_base (380)..(380): a, c, t, g, unknown or other
  modified_base (406)..(406): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttgccacgacggagtcgttggctgcagcagcaccagggccaccctcccaagcctccctctccgacaggaactaacactcccggccctcgacgggatccctacagagagtattctctcgcactccgaggtcaggaagcacacgcctccncgaccattactcggactaccgagtcngacgacgaagctagattattactgtctacagacagtacgggaccaccggtcctacgacggtcgtcgggttcggggttttccggacgggtacgggaaccgaaggcgtacggtacccggtcgtacggtacgaccggacccgg

SEQ ID NO: 399090 - DNA, 480 bp, Homo sapiens
  misc_feature: GZ8MTXP02FQSAC.10.1.A01.1.454.CMB.2.raw
  modified_base (379)..(379): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctccaagctcctctccgacaggaataacatccggccctcaggatcctcagagagattctctgcatccaggtcaaggaaagcacagccctccctgacccattacngactcagctgacgacgaagctgattattactgctcagcatggacaccggctcagtgcgtgggtttcgcggaggaccaagctgaccgtcacgtcacgacccg

SEQ ID NO: 399091 - DNA, 712 bp, Homo sapiens
  misc_feature: GZ8MTXP02GZWAL.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacagaccgccacactcacctgcacgtggaacaacaacaatgtcggccacgacggagtcgttggctgcagcagccaccgacgggccccaacccctcccaagccctccctccgtacccgacgaaggaaactaaccgacgtccccggccctacgaagggtactcccctacgaagacgagtacttcctctcgaccatccgaaggtacaaggaaacgccaacgaccgtcccttacccgtacgaaccctaacgtttaccgtcggtaaccctacccgaacgggtaccgtaacgggaaccggaaaccgtaacggtaccgttagtaaactttaacgtttaaccgtcgtaccgtacgtaacggacgtaacggtaccggggaaccgacccggtaccgtacggtaacggttcgggttacggggtttcgggggttttccggggaaccggggtaacggggtaaacccgtaaacgggtcccgttaccggtaaacccgggttccggtaaacgggtacccgaaccgggtaaccccgg

SEQ ID NO: 399092 - DNA, 573 bp, Homo sapiens
  misc_feature: GZ8MTXP02GSYGY.10.1.A01.1.454.CMB.2.raw
  modified_base (396)..(396): a, c, t, g, unknown or other
  modified_base (451)..(451): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctccaagcctcctctccgacaggaatacactccggccctgaggactcctacgagagagtattctctcgcactccgaggtccaaggaacaccaacacgccctcccgtagaccctagttaccncggacctaccgaggacctagaaaccgaccgaagtccgttagtaatttacttaacncgtacctacgaacgtcgaagtacgggaccaacccgggtcctacgaggtcggtccgggttcggggtttccggacgggtacggaccgaaagccgtacggacccgtcgtacggccacgaacccgg

SEQ ID NO: 399093 - DNA, 564 bp, Homo sapiens
  misc_feature: GZ8MTXP02JDT9U.10.1.A01.1.454.CMB.2.raw
  modified_base (384)..(384): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccagacggagtcgttgctgcagcagcaccgaggcccaccctccaagcctccctctccgacaggaaactaacacgtcccggacccctacgacgggtactcccgtcgaagagtagtacttctctggcctactcccgaaggtccaagggaacnccaccacgccctacccgtacgacctacgttactcggacctacccgaggcctaggaccgacgaacgctagtattatacgtgctactagcagtcggacaccgtcgtcgagtcggtacggtcgggtttccggacgggtaggaccgtaaggtcgtacggtaccgtccgtacggtcgacgacccg

SEQ ID NO: 399094 - DNA, 517 bp, Homo sapiens
  misc_feature: GZ8MTXP02FNI51.10.1.A01.1.454.CMB.2.raw
  modified_base (287)..(287): a, c, t, g, unknown or other
  modified_base (422)..(422): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgtagtgtcagtggtccaggcagggctgactcagccaccctcggtatccaaggacttgagacagaccgccacactcacctgcactgggaacaacaacaatgttggccacgacggagtcgttggctgcagcagcaccaggccacctcccaagctccnctccgacaggaataacatccggccctcgagggatctaccagacgagtacttctctgcatccaggtccaggaagcacacgccctccctgaccattactggacctcaggctagacgacgagctagattatactgctnagcagtggaccacggctcgagtcgtcggttcggggtttcggacgggacggaccgaacggcgtacggaccgtccgtacggtcacggcccgaacggg

SEQ ID NO: 399095 - DNA, 539 bp, Homo sapiens
  misc_feature: GZ8MTXP02FIWKC.10.1.A01.1.454.CMB.2.raw
  modified_base (315)..(315): a, c, t, g, unknown or other
  modified_base (338)..(338): a, c, t, g, unknown or other
  modified_base (383)..(383): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgtttggctgcagcagcaccaggccacccctccaagctcctctccgacaggaactaacatccggccctnacgggatccctcagagagattcnctgcatccagtcaggaagcacacgccctccctcgaccctattacncggactccacggctagacgaacgaagccgtagattacttactcgcttcgagacagacgggacgaacccggtcctacgaggtcggcgggttcgggttttcgggcgggtacgggaaccgaacggcgtacggacccgtccgtacggtcacgaaccccgg

SEQ ID NO: 399096 - DNA, 573 bp, Homo sapiens
  misc_feature: GZ8MTXP02HQLS8.10.1.A01.1.454.CMB.2.raw
  modified_base (334)..(334): a, c, t, g, unknown or other
  modified_base (358)..(358): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcactgcactggaacaacaacaatgttggccacgacggagtcgttggctgcagcagcacaggccaccctccaagctcctctccgacaggaatacactccggcctcgaggactcctacagagagatttcncttcgcactccgaggtcaggaacnccacacgccctccctacgacctattacgtcggtacctccgacggtctacggaaaccgaaccgaagtccttaggtaactttacgttaactcgacttacgagacagtcgggaccgacccggtactccgtaagtcggtcgggtttcggggttttaccgggacgggtacggggaaccgaaggtcgtcggtaccgtccgtacggtccgacgtaaccccgg

SEQ ID NO: 399097 - DNA, 479 bp, Homo sapiens
  misc_feature: GZ8MTXP02FG811.10.1.A01.1.454.CMB.2.raw
  modified_base (335)..(335): a, c, t, g, unknown or other
  modified_base (353)..(353): a, c, t, g, unknown or other
  modified_base (376)..(376): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctccaagctcctctccgacaggaataacatccggccctcagggatcctcagagagattcnctgcatccagtcaggaancacagccctccctgaccattacnggactccaggctgacgacgaagctgattatactgctcagcatgggacacggctcagtgcgtgggtttcgcggaggacaagctcgaccgtcacggtcagacccg

SEQ ID NO: 399098 - DNA, 678 bp, Homo sapiens
  misc_feature: GZ8MTXP02H78X6.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctctcactcactctgcagtgtcagtggtccaggcagggctgactcagccacctcgtatccaagacttgagacagaccgccacactcacctgcacgtaggaacaacaacaatgtcgccacgacggagtcgttggctgcagcagcaccgacggcccacccctccaagcctcctctaccgacaggaaactaacacgtcccggccctacgacggggactcccgtacgaagagagtactttctccgttcgactactcccgaaggttaccgaacggggaaacacccaaccgtaccggaccccttacccgtacggtaaccctaacgtttaccgtacggtaacccttacccggacgggtccgttaacggaaaccggtaccggtaaacgtcgttaggtaaactttaacgttacgtcgtacctacgtacgactaggaccgggtacccgacccggtccgtacgtggtacgttccggggtttacggggtttaccggggaccggggtacgggtaacccgaacgggtaccgtaccggtaccgttaccggttaccggtaccgtaccgaaccccggg

SEQ ID NO: 399099 - DNA, 600 bp, Homo sapiens
  misc_feature: GZ8MTXP02G7UOY.10.1.A01.1.454.CMB.2.raw
  modified_base (289)..(289): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttggctgcagcagcaccacggccacctccaagcctcctcnccgaacaggaactaacacgtcccggccctcgacgggatcccgtacagagacgtattctctgcatccgaggtccaagggaacgaccaacgacgccctaccctacgaaccctaacttactcggaccttaccgacggactacggaaccgaccgaaagctagtattacgttactgctacgacgcacgtacggggaccacccggtctaccgtggtcggttacggttcggggtttaccggggaccggggtaacgggaacccgaagggtcccgtacggtaccccggtacgtaccgggttaccgaccggtaaccccggg

SEQ ID NO: 399100 - DNA, 758 bp, Homo sapiens
  misc_feature: GZ8MTXP02ISCM6.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttgctagcagcagcaccaggcccaccctccaacgcctcctcctccgaacgaacggtaaactaaaccgacttccccgggccccttacgaacggggtacttccccgtaccgaaggtaacggtaacggtaactttacccgttcgtcggggtacctaaacgttaccccgtaaacggggttacccgaaaggggtaaaccgaccctaaaccgaaaccgggtcccccttaacccccgttacggaaacccctaacgtttaacccgttacggggtaacccgttaccccggaacgggtacccgttacgggtaaacccggaaaccggtaaaccgggtacccgttaaggtaacttttaacggtttaaccttacggtacccttaccgacgtaccgtaacgtacggggtaacccgacccgggtaccgtccgtacggttcggtacgggttacgggttttccggggacgggacgggtaaccgaacggtcgtacggaccgttccgtacggttacgaccgtacccgg

SEQ ID NO: 399101 - DNA, 529 bp, Homo sapiens
  misc_feature: GZ8MTXP02GHYIK.10.1.A01.1.454.CMB.2.raw
  modified_base (339)..(339): a, c, t, g, unknown or other
  modified_base (387)..(387): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttggccacgacggagtcgttgctgcagcagcaccaggccaccctccaacgctcctctccgacaggaactaacactccggccctcgaggactccctcagagagagttcnctgcatccgagtcaggaaagcaacacgccctcccgcgaaccatttacncggtacctccgaggctagaacgacgaagctgtaattagttactagctacagtacagtgggaccaccggctcgagtcgtacggttcgggtttcggcggtacggactaaggcgtacgaccggtccgtaggtccgacgaccccgg

SEQ ID NO: 399102 - DNA, 608 bp, Homo sapiens
  misc_feature: GZ8MTXP02ICAHV.10.1.A01.1.454.CMB.2.raw
  modified_base (191)..(191): a, c, t, g, unknown or other
  modified_base (373)..(373): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttganacagaccgccacactcacctgcacgtggaacaacaacaatgttggccacgacggagtcgttggctgcagcagcaccagggcccacccctccaagcctcctctccgacaggaaataaccatcccggccctacgacgggatccctacagacgagatttcctctgactatccgagtcaagggaancaccacgccctcccgtacgaccctaattacgtacggtacctaccgaggctacggaaacgacggaaacgtcgttagaacttttaacttaacgtcgacttacgacgtcgttaggtacggggaacccaacccggtcctaccgaggttcgtcggggttacggggtttccgggacggggtaacgggaaccgaacggtcgtacggtacccggtaccgtacgggtaccgaccggaaccccgg

SEQ ID NO: 399103 - DNA, 740 bp, Homo sapiens
  misc_feature: GZ8MTXP02H0M07.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcacgtaggaaacaacaacaatgttcggaccacgacggagtcgttggctgcagcagcaccgacggccacccctccaagcctccctcctaccgaacgaacggaaactaacacgtccccggaccctacgaacgggactcccgtacgaggtacgacgtacttcctctgacctacttacccgagggtaccaacgggaaacaccacgaccgcccctacccgtacgaacccttaacgtttaccgtaccggtaaccttacccggacggtaccgttaacggaaaccggtaacggtaaacggtacgtttaacggttaaactttaacgtttaaccgtacgtaccgttaaccgaacgtaccgtaacggtaccggggaaacccgtaacccggtcccgtaccggtaacgggttccggttaccgggggtttaacgggggttttccggggaaccgggggttaaccggggtaacccgaacgggtaccggttaccgggtaacccggttaccggtaaccgggttaccggaacccggtaaccccggg

SEQ ID NO: 399104 - DNA, 530 bp, Homo sapiens
  misc_feature: GZ8MTXP02JZNQT.10.1.A01.1.454.CMB.2.raw
  modified_base (340)..(340): a, c, t, g, unknown or other
  modified_base (359)..(359): a, c, t, g, unknown or other
  modified_base (421)..(421): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctcccaagcctcctctccgacacggaataacatccggccctcgagggactcctcagagagattcnctgcatccgagtcaggacncacacgcctccctcgaccacttactcggactccgagctacgacgacgaagctgtattattangctacagcgagtcgggacacccggcctcgaggtcggtacggttcggggtttcgggacggggacggtaccgaacgcgtacgacccggtacgtacggtaccacggacccgg

SEQ ID NO: 399105 - DNA, 662 bp, Homo sapiens
  misc_feature: GZ8MTXP02G2M7A.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgcacgacggagtcgttggctgcagcagcacacgggccaccctccaacgctcctctccgacaggaactaacatcccggaccctacgaggggactcccgtcagagagtacttctctgcactccgagtacaggacgcaacacgtccctccctacggaacctacgttaccgtcgggaccttacccgacgggacctacgggaaaccgaacggtaaaccggtaccgttagggttaacttttaacggtttaacctcggtaccctttacgaacgacggtaacgttaccgggggaacctaacccccgggtaccgttcgtaaacgggttcggtacggggtttcgggggttttaccggggaccggggtaacggggaaccgtaacgggtaccgtacgggtaccccggttacggttaccggtaccggtaccggtaaccccggg

SEQ ID NO: 399106 - DNA, 692 bp, Homo sapiens
  misc_feature: GZ8MTXP02H6904.10.1.A01.1.454.CMB.2.raw
  modified_base (288)..(288): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctctcactcactctgcagtgtcagtggtccaggcagggctgactcagccacctcggtatccaaggacttgagacagaccgccacactcacctgcacgtaggaacaacaacaatgtcggcacgacggagtcgttggctgcagcagcaccgacggccaccctccaagcctccnctccgacaggaataacacgtccgccctagacgggactcccgtacaagagagtacttcgtctgacctaactccgacggggttaccaacgggggaaacacccgaaccgtaaccgccccttaccccgttacggaacccctaacgttttaccgttacggggaaacccttcccggaacgggtccgtaacggaaaccggaacggaaacgtaccgttagtaatttaacggttaccttacgccttacgaaacggtctaacggttacggggaacccgaacccggtccgtacggttacgggttcggtaccggggtttcgggggttttaccgggacggggtacggggaacccgtaaacgggtccgttaaccggtacccggttaccggtacgggtaccgtaaccgggtaaccccgg

SEQ ID NO: 399107 - DNA, 623 bp, Homo sapiens
  misc_feature: GZ8MTXP02GEZKY.10.1.A01.1.454.CMB.2.raw
  modified_base (352)..(352): a, c, t, g, unknown or other
  modified_base (416)..(416): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcactgcactggaacaacaacaatgtggccacgacggagtcgttggctgcagcagcaccaggcccacccctccaacgcctcctctaccgacaaggaactaacactcccggaccctcgaacgggtactcctacgacgagagtattccnctgcactccgaggtaccgaagggaaagccaacgacgtccctcccgtagaccctaagtttaccgnggtacctcccgaggcctaggaaaccgacggaaagtcgtagtaattttaactacgtcgtactacgacgacgagtacggggaccaccgggtccctacggaggttcgggtccgggtttacggggtttcggggaaccggggtacggggaacccaaacggtcccggttacggttaccccggtacgttaacgggtaccgtacggaacccccgg

SEQ ID NO: 399108 - DNA, 593 bp, Homo sapiens
  misc_feature: GZ8MTXP02HFIR2.10.1.A01.1.454.CMB.2.raw
  modified_base (336)..(336): a, c, t, g, unknown or other
  modified_base (370)..(370): a, c, t, g, unknown or other
  modified_base (382)..(382): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgcacactcactgcactggaacaacaacaatgtcgccacgacggagtcgttggctgcagcagcacacggccaccctccaacgcctcctctccgacaggaacaacactccgcctacgaggtactcctcaagagagattcnctgcactccgagtcgaagacgcacacgccctccncgactacttacncggactcgagtcacgacgacgaacgtactagtaatttacgtacgtcgtactacgacgactacgtacgggaccgacccggtaccgtacgtacggtcggtccggggtttcggggttttaccggggacgggggttaaccgggaacccgaacgggtccggttaaccggtacccggttaccggttaaccgggtaccgtaaccgggtaacccccggg

SEQ ID NO: 399109 - DNA, 558 bp, Homo sapiens
  misc_feature: GZ8MTXP02IBNBF.10.1.A01.1.454.CMB.2.raw
  modified_base (344)..(344): a, c, t, g, unknown or other
  modified_base (347)..(347): a, c, t, g, unknown or other
  modified_base (364)..(364): a, c, t, g, unknown or other
  modified_base (378)..(378): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacctcggtatccaaggacttgagacagaccgccacactcacctgcactgggaacaacaacaatgtggccacgacggagtcgttggctgcagcagcaccgaggcccaccctccaagcctcctcctccgacaggaaataacacgtccgccctcgagggactccctacagagagtattcnctncatccgagtcaaggacncacacgccctcccncgaccattacgcgactcgagctacgacgacgaagtccgtagtaatttacttactcgtcgtacacgactacgtaacggaaaccgaacccgggtccctacgtaggtcgtcgggttcggggtttccgggacgggtaacgggaccgaacgtcgacggtaccgtccgtacggccgacgaccccgg

SEQ ID NO: 399110 - DNA, 747 bp, Homo sapiens
  misc_feature: GZ8MTXP02HGY0K.10.1.A01.1.454.CMB.2.raw
  modified_base (582)..(582): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccgaaggacttgagacagaccgccacactcacctgcacgtggaacaacaacatgtgcacgacggagtcgttggctgcagcagcaccgacggccacccctccaacgcctcctcctccgaacaggaaactaaaccgacgtccccggaccctacgaacggggtactaccccgtacgaaggaacgtacgtaactttccgtacttcggacctacgttacccgagggttacgaaacgggaaacgccaaaccgacgtaccccgttacccgtacggaaccctacgtttaacggtccgggaacccttaccggaacgggtccgtacggaaaccggacggtaaacgccgtttaaggttaactttacgttaacgtcggaccttacgtacggacttaacggtaccggggtaaacccnccccgggttacccgtacggtaacgggttccggggttaccgggggtttttcggggggtttacccgggaccgggggttaaccggggaaacccgtaacggggttcccgtaccggggttaacccccggttaccggttaacgggttaccccgtaaccgggtaacccccgg

SEQ ID NO: 399111 - DNA, 559 bp, Homo sapiens
  misc_feature: GZ8MTXP02IDMRO.10.1.A01.1.454.CMB.2.raw
  modified_base (381)..(381): a, c, t, g, unknown or other
tcagcatagtagtgcacgaccggtgctcgatttagacgtctcatcaggggtccaaacagagcttcagcaagcatagtgggaatctgcaccatgcccctgggctctgctcctcctgaccctcctcactcactctgcagtgtcagtggtccaggcagggctgactcagccaccctcggtatccaaggacttgagacagaccgccacactcacctgcactggaacaacaacatgttgccacgacggagtcgttggctggcagcagcaccgaggcccaccctcccaagcctccctctccgacaggaaataaccgatcccggccctacgagggactccgtaccagtagagtatttccactgccatcccgaaggtccaaggggaacnccaaccacgccctcccgtacgaacccattaccgtacggacttccgacggctgaccgaacgaacgactagtattattactgctcgagcgagtcgggacacccggtcctacgcgtcgtcggttcggggtttcggacgggtacggacgaacgcgtcgtaccgtcgtacggtcacggacccg

SEQ ID NO: 399112 - DNA, 579 bp, Homo sapiens
  misc_feature: GZ8MTXP02GKXI3.10.1.A01.1.454.CMB.2.raw
  modified_base (372)..(372): a, c, t, g, unknown or other
  modified_base (447)..(447): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgcacgacggagtcgttgctgcagcagcacgacggcccaccctccaagcctcctctccgacaaggaactaacacgtcccggcctcgaggtactccgtacagacgagtacttctcgtcgctacgtccgaggtcaagggaacnccacgacgccctcccacgaacctattacgcggacctccgacgctacggacgacgaacgtctagtatttacgtacngtcctacgacgtcgagttacgggaaccctacccggtctacgtcggtcggttcggggttcggggtttccgggacgggtaacgggacccgtaaggtccgtacggtaccgtcgtaacggtccgaacgtaccccgg

SEQ ID NO: 399113 - DNA, 572 bp, Homo sapiens
  misc_feature: GZ8MTXP02I86O9.10.1.A01.1.454.CMB.2.raw
  modified_base (287)..(287): a, c, t, g, unknown or other
  modified_base (373)..(373): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtgggaacaacaacaatgttcggccacgacggagtcgttgctgcagcagcacaggccaccctccaagctccnctaccgacaaggaactaacactcccggccctgaagggtctaccgtcaaggacgagactttcgctgcaatcccaaggtcaagggaancaacacgccctccctagacctaattacgtggacctcgaggccgtacgaaccgaacggaaacgacgttagtaacgtttaacttacgtgacttaccgagcagtcggggacaaccggcctacgaggtcggtacgggttcggggtttccggacgggtaagggacctaaggcgtacggaccgtccgtaacggtccgacgacccg

SEQ ID NO: 399114 - DNA, 749 bp, Homo sapiens
  misc_feature: GZ8MTXP02HPM8P.10.1.A01.1.454.CMB.2.raw
  modified_base (283)..(283): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgccacgacggagtcgttggctgcagcagcaccacggccaccctccaagcnccctctccgacaggaactaacactccggccctcgaggggactccctacgaacgagtacgtactttccgttcgtggacctactaccccgtaaggggttacccgaagggaaaacgcccgaaccgaacgcccccgttacccgtacggaaccctaacgtttaaccgttacgggaacccttacccgacggggtaccgtacggaaaccgggtaaaccgaaacggtaccgttaaggtaactttttaacgttaaaccgttcggtaccttaccgtaacggacgtaacgggttaccggggaaacccgaaccccggggtcccgtaccggttaaacggggttccggttaccgggggtttacgggggtttttcccgggggaccgggggttaaaccgggggaacccgtaaacggggtccgttaaccgggttaccccgggtacccggtttaacggggtacccgtaacggtaaccccccggg

SEQ ID NO: 399115 - DNA, 597 bp, Homo sapiens
  misc_feature: GZ8MTXP02I4T1Z.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccaggccaccctccaacgcctcctctaccgacaggaactaacactcccggaccctgacgggtactccgtacagagagtattctctgcctatccgagtcgaagaacgcacgacgcctaccctagacctattacgtcggacttaccgacggtactacggaaccgaacgtaaacggtccttagtaaacgtttacgttaactcgtaccgttacgacgtacgtacgtacggggaccacccgggtctaccggaggttcggtacggttcggggtttccgggacgggtacggaacgtaacggtcgtaccgtaccggtacgtacggtacaaccggtacccg

SEQ ID NO: 399116 - DNA, 581 bp, Homo sapiens
  misc_feature: GZ8MTXP02GGVR7.10.1.A01.1.454.CMB.2.raw
  modified_base (373)..(373): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcaccgagggcccaccctccaagcctcctctccgacaggaataacatcccggcctcgacgggactcctcagagagtattctctgcatccgagtcaaggagcacacgtccctccncgacctacttacgtcggacctaccgagctacgaacgacgaacgtcgtagtactttaacgttactcgtactacacgtactagtacggggaccgacccggtacctacgtacgggtcggtccgggtttcgggggtttccgggaccggggtacgggaccgaacggtccgtacggtacccggttaccgtaacggtaccgaccggtaaccccgg

SEQ ID NO: 399117 - DNA, 647 bp, Homo sapiens
  misc_feature: GZ8MTXP02GULUO.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgttggctgcagcagcaccgacgggcccacccctccaacgcctcctcctccgacaggaactaacatcccggcctcgagggactcctcagagacgtattctactgcatccgagtccaaggacgcaaccagccctccctacgacctaattacgtacggacctaccgacggctcggaaacgacgaaagacttagtaactttaacgttacgtacgtcgtacgaacggtacgtacggttacggggacccgaaccccgggtaacccttcccggtaagggttcgggttaccggggtttcgggggtttttaccggggaccgggggttaaccggggtaaccgaaaacgggtccggttaccgggtacccggttacccggtacgggttacccgaaccggtaacccccggg

SEQ ID NO: 399118 - DNA, 670 bp, Homo sapiens
  misc_feature: GZ8MTXP02JYASM.10.1.A01.1.454.CMB.2.raw
  modified_base (379)..(379): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgttgctgcagcagcaccgacggcccacccctccaacgcctcctcctaccgacaaggaaactaacgactcccggcctcgagggtactccgtacagagagtacttctacgtgcacgtccgagtacgaagggacncaacacgcctccctacgacctatacgtcggacctccgacggctacgaaccgaacggaacgtaccgtagttaactttaacgtttaccgtacgtaccgttacgacgacgtaacggttacggggaacccgtacccgggtacccgtacggtacggttccggggttaccgggtttccgggggttttaccggggaccgggggtaaccgggggtaacccggaaacgggtcccggttaacccggggtaccccgggttaccggtaccggggttacccggtaacccgggtaaacccccggg

SEQ ID NO: 399119 - DNA, 544 bp, Homo sapiens
  misc_feature: GZ8MTXP02IKRPF.10.1.A01.1.454.CMB.2.raw
  modified_base (319)..(319): a, c, t, g, unknown or other
  modified_base (323)..(323): a, c, t, g, unknown or other
  modified_base (334)..(334): a, c, t, g, unknown or other
  modified_base (354)..(354): a, c, t, g, unknown or other
  modified_base (377)..(377): a, c, t, g, unknown or other
  modified_base (388)..(388): a, c, t, g, unknown or other
  modified_base (413)..(413): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactaggaacaacaacaatgtcggaccacgacggtagtcgttggctgcagcagcaccgacggccacctccaagcctcctcacgacagaactacactccgcctgaggntccncagacatatcnctgacatccgagtcaaggancacacgcctccagacctattacngactacgagcngacgaacgaagctagtattattacncgtatacagaccaagtcgggaaacccgaccggtactacgtggtcggttacgggttacggggttaccgggacgggtaacggaacgaacgtccgtaaccgtaccggtaccggtacggtaccgaccggaacccg

SEQ ID NO: 399120 - DNA, 667 bp, Homo sapiens
  misc_feature: GZ8MTXP02H3MEK.10.1.A01.1.454.CMB.2.raw
  modified_base (276)..(276): a, c, t, g, unknown or other
  modified_base (288)..(288): a, c, t, g, unknown or other
  modified_base (371)..(371): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccgaaggacttgagacagaccgccacactcacctgcactggaacaacaacatgtcggccacgacggagtcgttgctgcagcagcaccgaggccacccnccaagctcctcnccgacaggaactaacactccggccctcgaggactccgtacagagagtacttctctgacactcccgaaggttaccagggaaacnccgaaccgacgaccccgtccctacggaaccctaacgtttaccgtacggaccgtaccgacgggtactacggaaccgtacggaaacgtcgtacgtaactttacgttacgtacgtccgtacgtacggacctaacggtacgggaacccgtacccggtacccgtacggtaaacggttccgggttaccggggttacggggtttttaccgggggaccggggtaacggggtaacccgtaacggtaccggttaccggtacccgggtttacccggtaccggtttacccggaacggtaacccccggg

SEQ ID NO: 399121 - DNA, 694 bp, Homo sapiens
  misc_feature: GZ8MTXP02G1YJL.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccgaaggtacttgagacacgaccgccacactcactgcacgtaggaacaacaacatgtcgcacgacggagtcgttggctgcagcagcaccgacggcccaccctccaagcctcctcctaccgaacgaaggaactaaccacgttcccgaccctcgaacgggtactcccgtacgagagacgtacgttcctacgtcgactacgttaccgacgggttacgaacgggaaacgaccgaaccgacgtccccgtacccgtaccggtaaccctaacgttaccgttacggaccttaccgaacgggtaccgtacggaaaccggtacgaacggtacgttacggtaacttacgttaccgtacgtacgtacgacgtacgtacggtacgggaaacccgtacccggtaccgtaccggaggttaccgggtccgggttcggggttttaccggggaccggggtacggggtaacccggtaacggtacccggtacggttacccgggtaccgttaaccggaccgtaccggtaaccccggg

SEQ ID NO: 399122 - DNA, 686 bp, Homo sapiens
  misc_feature: GZ8MTXP02HQJ8L.10.1.A01.1.454.CMB.2.raw
  modified_base (351)..(351): a, c, t, g, unknown or other
  modified_base (378)..(378): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacagaccgccacactcacctgcacgtggaacaacaacaatgtcggcacgacggagtcgttggctgcagcagcaccgaggcccacccgtccaagcctcctctccgacaggaactaacacgtcccggacctacgagggactcctacgagagagtattcctntgcctatccgaggtaccgaaggaaacnccaaccacgtccctacccgtacgtaaccctaagtttaccgtacggtaccttacccgagggtaccctaggaaacccgaacggaacgtccgttagtaactttaacgttaaccgtgtaccttacgaagaccgttaaacggtcggggaaacccaccccgggtacccgttccggtaaggggttccggttaccgggggttttcggggttttacccgggggaccggggttaaccgggggtaacccgaaaacgggtcccggttaccgggttaccccgggtacccgttacgggttacccgaaccggtaacccccggg

SEQ ID NO: 399123 - DNA, 666 bp, Homo sapiens
  misc_feature: GZ8MTXP02H0CQU.10.1.A01.1.454.CMB.2.raw
  modified_base (402)..(402): a, c, t, g, unknown or other
  modified_base (439)..(439): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtggaacaacaacaatgtcggaccacggacggagtcgttggctgcagcagcacgacggccacccctccaacgcctccctcaccgtacgaaggaaaactaaccacgtcccggccccttaggacggggtactcccgtaccgaagagacgtactttctacgtgccaactcccgaggtacaaggggaaacnccaccgacgccctcccgtacgtaacccacgtttaacncgggtaaccttcccgagtaccgtagaaaccggacgtaacgacgttagtaactttacgttaccgtacgtccgttacgacgactaacggtacgggaacccgaaccccggtcctaacgtcggtcggttcggggtttcgggggtttaccggggaccgggtaacgggtaccgtaaacggtccggtaccggtacccggttaccgtaacgggttaccgtacccggaaccccggg

SEQ ID NO: 399124 - DNA, 501 bp, Homo sapiens
  misc_feature: GZ8MTXP02H7RZI.10.1.A01.1.454.CMB.2.raw
  modified_base (333)..(333): a, c, t, g, unknown or other
  modified_base (350)..(350): a, c, t, g, unknown or other
  modified_base (358)..(358): a, c, t, g, unknown or other
tcagcatagtagtgcacgaccggtgctcgatttagacgtctcatcaggggtccaaacagagcttcagcaagcatagtgggaatctgcaccatgccctgggctctgctcctcccgaccctcctcactcactctgcagtgtcagtggtccaggcagggctgactcagccaccctcggtatccaaggacttgagacagaccgccacactcacctgcactgggaacaacaacaatgtggccacgacggagtcgttggctgcagcagcaccaggccaccctccaagctcctctccgacaggaataacatccgccctcaggactctccagagagattcnctgcatccaggtcagancacacgcnccctgacattactgactcagctagacgacgacgctagtattattactgctcagcagtggacacggcctcgaggtcgtcggttgggtttcggacgggtacggaccgtaacgcgtcggaccgtcgtacggtcgacgaccgaacgg

SEQ ID NO: 399125 - DNA, 637 bp, Homo sapiens
  misc_feature: GZ8MTXP02FWYUO.10.1.A01.1.454.CMB.2.raw
  modified_base (206)..(206): a, c, t, g, unknown or other
  modified_base (241)..(241): a, c, t, g, unknown or other
  modified_base (246)..(247): a, c, t, g, unknown or other
  modified_base (249)..(250): a, c, t, g, unknown or other
  modified_base (277)..(277): a, c, t, g, unknown or other
  modified_base (292)..(292): a, c, t, g, unknown or other
  modified_base (362)..(362): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggtacttgagacagaccgccacnctcacctgcactggaacaacacatgtgcagacggntgtgnngnngcagcacgacgccacctccagcctccncaccgacagaacacncgtcccgccagaggactcctacgagagtagtacttcgtactcgactacgtaccgaggtccgaagggaacnccacgacgttccccctacgacgaaccttaacgtttacgacgtaaccctacccggacggtaccgtacgaaacccggaagtaacgtccgttaagttactttaaacgtttcgaccggtaccttacgaacggtaccgtaggaacccgggggtaccaaccccgggtccgttaacggacggggtttccgggtaaccggggtttttcgggggttaccggggacgggacggtaaaccgtaacgtcgtaacggtacccgtacggttacgacccgacgaccccgg

SEQ ID NO: 399126 - DNA, 550 bp, Homo sapiens
  misc_feature: GZ8MTXP02I1QAH.10.1.A01.1.454.CMB.2.raw
  modified_base (438)..(438): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgttggctgcagcagcaccacgggccaccctcccaacgcctcctcctccgacacggaaactaaacactcccggccctcgaagggactccctacagagagtacttctctgcactccagtcaaggaagcacacgccctccagacctattacgtggactcgagctacgaacgacgaagctagattatactgctanagtcagtcggaccaccggcctacgacggtcggtcggttcggggtttccgggacgggtacgggtaccgaaacggtcgtacggtacccgtcgtaacggtccgacggtaccccgg

SEQ ID NO: 399127 - DNA, 583 bp, Homo sapiens
  misc_feature: GZ8MTXP02GFK03.10.1.A01.1.454.CMB.2.raw
  modified_base (362)..(362): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggtacttgagacacgaccgccacactcacctgcacgtaggaacaacaacaatgtcggcccaacggacggagtcggtttgctgcagcagcaccgacggcccaccctccaacgcctcctcctaccgacgacggaactaacacgtcccggacctcgaggactcctcgagagagtacttctcncgctactccgtagtacgaaggacgccaacgacgacccctaccgtacgacctaattacgtaccggtacctacccggagccgtacgaacgaaccggaatcgttagtaactttacgtaacgtcgacctacacgctaggacggaccaccgggctacgtggtcggtcggttcgggttacggacgggtagaccgcgtcgtacgtacccgtgtacgcgaacggtcccg

SEQ ID NO: 399128 - DNA, 548 bp, Homo sapiens
  misc_feature: GZ8MTXP02ICBXL.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtgccacgacggagtcgttggctgcagcagcacagggccaccctccaagctccctctccgacaggaactaacactccggccctcgagggactcctcagacgagtattcgtctgcactccgagtccgaggagacacacgccctccctgaacctacttactacggtactaccgagctacgacgacgaagctagtattagttactgctacagacagacgggacaccggtcctcgtacggtcggtcggttcggggttttccgggacgggttacggaccgaacggcgtacgtaaccggtccgtacggtaccacggaaccccgg

SEQ ID NO: 399129 - DNA, 593 bp, Homo sapiens
  misc_feature: GZ8MTXP02HI9YU.10.1.A01.1.454.CMB.2.raw
  modified_base (496)..(496): a, c, t, g, unknown or other
  modified_base (517)..(517): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactaggaacaacaacaatgtggccacgacggagtcgttggctgcagcagcaccgacggtccccacccctcccaacgccctccctccgtcccgaacgaacggaaacttaaaccgaacttccccggacccctacgacggggtactccccgtaccgagagacgtattctcgtgctatcccgagtacaaggaacgcaccacgccccgtcccgcgacctacttacgtacgtacctccgacgctacgacgacgagcttagtatagttactcgactcgaagtcgaacgngggtaccgacccggtctacgngtcggtcggttgggggtttccggcgggtaggaccctaacggtcgtacggcccgtacgtacgtaccgacgaacccgg

SEQ ID NO: 399130 - DNA, 707 bp, Homo sapiens
  misc_feature: GZ8MTXP02FMTF4.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacacgaccgccacactcacctgcacgtggaaacaacaacaatgttggacccacggacggagtcgtttggctgcagcacgccgaccgacggccccacccctcccaacgcctcctcctaccgacaggaactaacacgtcccggccctacgacggtactcccgtacaacgagacgtacttcctactggacctacgtaccgaggtaccgaacgggaaacggccaaccgaccgtccccttacccgtacgtaccctaaacgtttaccgaccggtaacccgttacccgaaggtacctaggaaaccggtaacgaaacggtctaggtaactttaaagttaccgtacggtccttacgacgtacgtaacggttaccggggaaccaccccgggtaccgtacgtacgggttcgggttaccggggttttacgggggtttccgggaaccggggtaaccggaaccgtaacgggtcccgttaaccgggtaccccggtaccggtttaccggaccgtaaccggtaacccccggg

SEQ ID NO: 399131 - DNA, 761 bp, Homo sapiens
  misc_feature: GZ8MTXP02J1QPK.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagcccaccctcggtatccaaggacttgagacagaccgccacacctcacctgacacgtgggaacaacaacaatgttcggccacgacggagtcgttggctgcagcagccaccgacgggccccacccctcccaacgtcctccctcctacccgaacgaacggaaactaaccacgtccccggacccctacggagggtactccgtaccgaagtacgaacgttacttcctcgtcgacctaacgtacccgaggtacgaaacgggaacgacccgaacgtaaccgccccttaccccgtacggtaacccctagtttacccgacggtaaccccgttacccggaacgggtacccgttaacgggaaacccgggaaccggtaaaccggttcgttaacggtttaaacttttaacgtttaaccgtcgtaccgtttaacgacggttaccgaacgggttaccggggaccccgtaaaccccgggttccgtaccggtacggggttccgggtttaacgggggtttccgggggtttacccggggacggggtaaccggggaacctaacgggtccgtaaccgggtcccggttaaccggttcgggacccgaccggtaaccccgg

SEQ ID NO: 399132 - DNA, 733 bp, Homo sapiens
  misc_feature: GZ8MTXP02GACLQ.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacacaatgtgcacgacgagtcgttgctgcagcagcacaggccacctccaacgcctcctcctaccgactaaggaaaactaacgacgttcccggaccctacgaacgggtactcccgtaccgaaggaacgtaacggtactttccctacttggacctaaacgttccccgtaacggggttaccgaaaggggtaaaacgacccgaaaccgacccggtacccttaccccgtacgtaaaccctaacgtttaaccgtaccggtaaccgttaccgaacgggtaccgtacggaaacccggtaaccggaaacgtaccgttaacggtaactttaaacgttaccgtaaccgtccgttaccgtaacgaaccgtacgttaccggggaaccgtaaccccgggtaccttaccgtaaacggttccggttaccggggttacggggttttaccgggaccggggtaaccgggaaccgaacggtacccgtaacggtaccccggtaccgtaacggtaccgaaccgtaaaccccgg

SEQ ID NO: 399133 - DNA, 608 bp, Homo sapiens
  misc_feature: GZ8MTXP02IMVJJ.10.1.A01.1.454.CMB.2.raw
  modified_base (349)..(349): a, c, t, g, unknown or other
  modified_base (370)..(370): a, c, t, g, unknown or other
  modified_base (374)..(374): a, c, t, g, unknown or other
  modified_base (382)..(382): a, c, t, g, unknown or other
  modified_base (393)..(393): a, c, t, g, unknown or other
  modified_base (433)..(433): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacacctcacctgcacgtggaacaacaacaatgtcggccacgacggagtcgttggctgcagcagcaccgaggccccaccctccaacgcctcctcctccgacacggaactacacgtcccggcctacgaggactcctcgagagagtattcnctgcactccgagtcaaggacncacncgcctccngacctattacncggactccgagctagacgacgaagctagtattacgttacncgtacacgtagacgtacgtacgggaaccgccccggtacgttaccggaggttccggggtttccgggtttacgggggttttcccggggaacggggtaaccggggtacccgtaaacggtcccgttacggggtaaccccggttaccggtaaacgggttccgaccccggggtaaccccgg

SEQ ID NO: 399134 - DNA, 658 bp, Homo sapiens
  misc_feature: GZ8MTXP02IVXTT.10.1.A01.1.454.CMB.2.raw
  modified_base (228)..(228): a, c, t, g, unknown or other
  modified_base (394)..(394): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactggaacaacaanaatgtgccagacggagtcgttgctgcagcagccaccgacgggcccacccgtccaacgcctaccctacctccgaacgaacggtaaactaaccgactcccggaccctacgaggactctacgaacgagaacgtacttctctcgctacgtaccgaggtacgaacggaacncaacacgccctacccgacgaaccctacttacgtacgacctcgtaacggacgtacgaaccggaacggaaacgtcgttacgttaaacgttacttaccgtacgtaccttacgacggtacgtacggtacgggaccgtacccgggtacccttacgggtacggttcgggtacgggtttcgggggtttacgggaccggggtaacgggttaacccgaacgggtccgtaaccggtacccgttaccggtaccggtaccggacccggtaacccgg

SEQ ID NO: 399135 - DNA, 681 bp, Homo sapiens
  misc_feature: GZ8MTXP02IT1RI.10.1.A01.1.454.CMB.2.raw
  modified_base (236)..(236): a, c, t, g, unknown or other
  modified_base (269)..(269): a, c, t, g, unknown or other
tcagcatagtagtgcacgaccggtgctcgatttagacgtctcatcagggggtccaaacagagcttcagcaagcatagtgggaatctgcaccatgcccctgggctctgctcctccctgaccctcctcactcactctgcagtgtcagtggtccaggcgagggctgactcacgccaccctcggtatccgaaggtacttgagacagaccgccacactcacctgcacgtaggaacaacaanaatggtcgcgacgacggtagtcgttgctgcagnacgcaccgacggaccacccctaccaacgcctaccctccgtaccgaaccaaggtaaactaaaccagtcccccggcctacgaagggtactacctacgagagacgtaattccgtactgacctactaccgtagtacgaaggaaacgccgaaccacgtccctacccgacgaaccctaacgtttaacggaccgtaaccgttacccgaacgggtaccgtaacggaaccggtaaacccggtaaaagccgttagtttaaacgtttaacttacccgtagtcctaacgacggtaacaccgggttaacgggacctaacccgggtaccctagggtaaggttccggttgggggtttaccgggtttcggggaccgggaacggtacgaaccgtcgaaccggtacgtacgtacggtcgaacgtacccgg

SEQ ID NO: 399136 - DNA, 705 bp, Homo sapiens
  misc_feature: GZ8MTXP02IU6GS.10.1.A01.1.454.CMB.2.raw
  modified_base (283)..(283): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacctgagacagaccgccacactcactgcactggaacacacaatgtcgcacgacggagtcgttgctgcagcagcaccgacggccaccctccaagcctccncctaccgacaggtaactaaccacgtccccggccctacgaaggggtactcccgtaccgagacgtacgtactttcctcgttggcctaactcccgagggtaccgaagggaacgccaaccgacgtacccctcccgtacggaaccctaagttaccgtacggtacctacccggtaaagggcctaacggaccggaaacggtaacggacccttaggtaactttacgtttaacccgttgacccgtacgtacggaccgttacggtacgggggtaacccgaaccccgggtccttacggtaacgggttcgggtacccggggttttcgggggtttcccggggaaccggggttacggggaaacccgtaacggtccggtaccgggttaacccccggttaccggtaaccggttaccggtaacccggtaacccccgggg

SEQ ID NO: 399137 - DNA, 747 bp, Homo sapiens
  misc_feature: GZ8MTXP02GSNDT.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccgaaggacttgagacacgaccgccacactcacctgcacgtaggaacaacaacaatgtcggaccacggacggtagtcggttggctgcagcacgccaccgacggcccacccctccgaacgcctcctacctaccgaacgaacggaaactaaccgacgttccccggaccctacgaacgggtactcccgtacgaggacgacgtacttccgtctcggacctacgtaccggtagggtaccgaaagggggaaccacccgaacccgtaccggtcccccttacccgtaaccggtaaacccttaacgtttacccggtaccggggtaaccccttacccgggaacgggtacccgttaaccgggaaaccggtaaaccggtaaaccggttcccgttaaggtttaacctttttaacggtaaccgtacggttacccacggtaacgaccgtaagggtaccgggaacccgtacccggtctacggtacggttcggggtacgggtttcggggtttaccggaaccgggggacggtaccgtaacggtccggttacggtacccgtacggtacggaccgacggtaaccccgg

SEQ ID NO: 399138 - DNA, 611 bp, Homo sapiens
  misc_feature: GZ8MTXP02HL1B5.10.1.A01.1.454.CMB.2.raw
  modified_base (404)..(404): a, c, t, g, unknown or other
  modified_base (490)..(490): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttcgaccacgacggtagtcgttggctgcagcgagccaccgacggccacccctccgaacgtcctaccctcgtacccgaacgacggaaactaaccgaccgtcccggccctacgacgggtactcccgtacgagacgagtacttccgtctcgcacttccgagggtccaagggaacncaacgacgcccttacccgacgacctaactacgtcggacctaccgacgtctacgaacgaacgacgtacgttacgtaattacttaacncgtacctacgacgcgtacggaccgggaaccgcccgtcgtacgaggttcggtcgggttcgggttcggacggtacgggaccaacggcgtacggtaccgtacgtacggtaccgacggaaccccg

SEQ ID NO: 399139 - DNA, 532 bp, Homo sapiens
  misc_feature: GZ8MTXP02IT45G.10.1.A01.1.454.CMB.2.raw
  modified_base (277)..(277): a, c, t, g, unknown or other
  modified_base (368)..(368): a, c, t, g, unknown or other
  modified_base (373)..(373): a, c, t, g, unknown or other
  modified_base (429)..(429): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccgaaggacttgagacagaccgccacactcacctgcactggaacaacacaatgtcgcacgacggagtcgttggctgcagcagcaccgacggcccacccnccaagctccctctccgaacacggaaactaacactcccggcctcgaggatccctacagagagtacttctctgcacgtccaggtccaaggacncacgngccctcccgtcgacctattacgtcggactcgaggctgacgacgtagctagtacttntacgtgctacagcgagtacggacgaccgctacgagtcggtcggttcgggttcggacggtacggaccgtaaggccgtacgaccgtcgtacggtcgacgtacccg

SEQ ID NO: 399140 - DNA, 583 bp, Homo sapiens
  misc_feature: GZ8MTXP02HCZLF.10.1.A01.1.454.CMB.2.raw
  modified_base (290)..(290): a, c, t, g, unknown or other
  modified_base (342)..(342): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgtggccacgacggagtcgttggctgcagcagccaccacggccaccctccaagctcctccncgacaaggaactaacactcccggccctcgaggactcccacagagagtattcnctgctatccgagtcaagagcacacgccctcctacgaccacttacgtacggactccgacggcgtacgacgaacgaaagctagtaacttacttaacgtacgttacacgtacgacacgtacgggaaccgaccggtcctacgtaggtcggttcgggttacggggttttcggggaccggggttacggggaaccgtaacggtcgtaacggtacccgtaaccggtacggttaccgacggtaaccccgg

SEQ ID NO: 399141 - DNA, 666 bp, Homo sapiens
  misc_feature: GZ8MTXP02FF2AS.10.1.A01.1.454.CMB.2.raw
  modified_base (422)..(422): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactaggaacaacaacaatcgttcgccccacggacggtagtcgtttggctgcagcagcaccagggcccaccctccaacgcctcctctcccgacaggaaactaacagtcccggccctgacgggatccctacagagagtattctctcgcacttcgacgtacgaggaacgcacgacgtccctcccacgaccctattaaccgcggacctaccgnggtactacgaccgacgaaacgtctagtaatttaacttacgtcgtcgttacacgtaccgaaggtaccggggacccgtaaccccgggtaccctacggaagggtttccggtccggggttttaccgggggtttttacccgggggaccgggggtaaccgggggttaaacccgaacgggtacccgggttaaccggtacccccggttaccgggtttaaaaccggggtaccgtaccgggtaaaccccccggg

SEQ ID NO: 399142 - DNA, 679 bp, Homo sapiens
  misc_feature: GZ8MTXP02IACDI.10.1.A01.1.454.CMB.2.raw
  modified_base (360)..(360): a, c, t, g, unknown or other
  modified_base (383)..(383): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctctcactcactctgcagtgtcagtggtccaggcagggctgactcagcccaccctcggtatccaaggacttgagacagaccgccacactcacctgcacgtaggaacaacaacaatgtcggaccacgacggagtcgttggctgcagcagcacgacggcccaccctaccagcctcctcctccgaacaggtaactaaacacgtcccggaccctcgagggtactcccgtacgagacgagtactttcnctcgctatccgaggtacaggacncccaacaccgaccctacccgtacgaccctacgttaccgtacggtaccttccgacgggtccgttacggaaaccggaacggtaaacgtaccgtttaaggtaaactttacgttaaaccttcgtaccgttacggtaacgtcgaacggttacgggaacccgacccggtacccgtacggtacgggttacggttccgggggtttaccggggttttaccggggaccgggggtaaccggttaccggaaacggtccggtaccggtacccggtaccgtaaccgggtaccgtaaccggaacccccggg

SEQ ID NO: 399143 - DNA, 579 bp, Homo sapiens
  misc_feature: GZ8MTXP02FJZQA.10.1.A01.1.454.CMB.2.raw
  modified_base (248)..(248): a, c, t, g, unknown or other
  modified_base (368)..(368): a, c, t, g, unknown or other
  modified_base (432)..(432): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggaccttgagacagaccgccacactcacctgcactggaacacaacatgtgcacgcgagtcgttggncagcagcaccgcgggcccacccgtccaagcctcctctccgacaggaactacactccggccctcgagggactcgtccacggtagagtacttccgtcctgccatacccaggtacaagggacncacacgtccctacccgtacgaacctattaccgtacggacctccgaacggtcacgacgacgaacnctgtattatactgcctcacgctacgacgggaccaccgggtcctacgacgttggtaccggtttcggggtttaccggacggggttaacggaacccgtacggtccgtacggaacccggttcgtaaccggtcaaccggtcccgaacccggg

SEQ ID NO: 399144 - DNA, 606 bp, Homo sapiens
  misc_feature: GZ8MTXP02H7R2A.10.1.A01.1.454.CMB.2.raw
  modified_base (293)..(293): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccgaaggacttgagacagaccgccacactcacctgcactggaacaacaacaatgttggccacgacggagtcgtttggctgcagcagcacacggccaccctccaagcctccctccnccgacacggaactaacactcccggaccctcgacgggactccctacgagagagtactttcctctgctacttaccgaggtccaagggacgccacacgccctccctacgacctacttacgtcggacctccgaggtacacggacgaacggaaacgcgttagtaatttaacgttactacgtaccgtacaacgtacgacgtcggggaactaccccgggtaccttacgcggttcgggtcgggttcggggttttccgggacgggtacgggaccgaaacggtccgtacggtacccggtaccgtacggtccgacggaccccgg

SEQ ID NO: 399145 - DNA, 718 bp, Homo sapiens
  misc_feature: GZ8MTXP02FG30A.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgccaccctcggtatccaaggacttgagacagaccgccacactcacctgcactggaacaacaacaatgtggcacgacggagtcgttgctgcagcagcacgaggccaccctccaacgctcctctaccgacaaggaataaccacgttccccgggacccctacgaacggggtactccccgtaccgaaggacgtacgtacttttccgcttcggacctaacgttcccgaaggggttaccaaaggggaaacgcctaaaccgaacggtccccctacccgttacgaaccctaaacgtttacccacggggtaacccttacccggaggacccgttacggaaaccggtaacgaaacgtccgtaggtaaactttaacgtttaaccgtcgtaccgtacgacgtacgtaaggtaccgggaacccgtacccggtaccgtacggtacgggttaccgggttacggggtttaccgggggttaccggggaccggggtaaccggtaacccggtaacggtacccggtaacccggttacccggtaccggttaaccggtaccgacccggtaaccccg

SEQ ID NO: 399146 - DNA, 609 bp, Homo sapiens
  misc_feature: GZ8MTXP02I103D.10.1.A01.1.454.CMB.2.raw
  modified_base (328)..(328): a, c, t, g, unknown or other
  modified_base (335)..(335): a, c, t, g, unknown or other
  modified_base (464)..(464): a, c, t, g, unknown or other
  modified_base (484)..(484): a, c, t, g, unknown or other
  modified_base (499)..(499): a, c, t, g, unknown or other
  modified_base (569)..(569): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcgagggctgacctcacgccctacccgtcggtactaccgaaggtaccttaggagaccacgacccgaccacacctcacctgacacgtacggaaaccaaactaactaagtcggtacggacccgtacggacggtagttcgttggctgcagcacgcaccgacgcccacccgccacgcctccncaccganaacggtaactacgaccgtcccggacctaggaacggtctcccgagacggtagacgttacttcctcgagtcctacggttaccgacggacgaacggacaccaccgtaccgtccctacgtacactacgttacncggactcgcgtcagacgaangtcgttatatctacncgatcgatacgtacgcgacctccgtcgtcgtacgtcgggtacggtttcggggtccgaacgggtccgaacncggtccgtacggaccgttccgacgacccgtacgtacccgg

SEQ ID NO: 399147 - DNA, 676 bp, Homo sapiens
  misc_feature: GZ8MTXP02JCSSR.10.1.A01.1.454.CMB.2.raw
  modified_base (235)..(235): a, c, t, g, unknown or other
  modified_base (287)..(287): a, c, t, g, unknown or other
  modified_base (320)..(320): a, c, t, g, unknown or other
  modified_base (401)..(401): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcacgcccaccgtcggtatccgaaggacttgagacacgaccgccacacctcacctgcacgtcggaaacaacaanaatgtacggccacgacggagtcgttggctgcagcagcacgacggcccacccnccaagtcctcctactaccgacgaagaactaacnctacccggcctcgaggtactcccgtacacgtacgacgtcttactcgtgacctacgtaccgtaggtaaccgaaggggaaccnccgtaaaccgcggtacccctaccctacggtaaccctaactttaaccggccggaaaccgttcccggaagttaccgtacggaaccggaaaccgtaaacggtactacgttaactttacgtacctagtcctacgaacgtcaacggttcggaaaccgaccgtccgtcgtacgggttccggtcgggtttaacgggggtttccgggaaccggggacgggtaaccgtaagggtcccgttaaacggtcccggtaccggttacggtaccgaaaccggaccccggg

SEQ ID NO: 399148 - DNA, 634 bp, Homo sapiens
  misc_feature: GZ8MTXP02GUAXX.10.1.A01.1.454.CMB.2.raw
  modified_base (279)..(279): a, c, t, g, unknown or other
  modified_base (293)..(293): a, c, t, g, unknown or other
  modified_base (395)..(395): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcacgtggaacaacaacaatgtcgccacgacggagtcgttggctgcagcagcaccgacggcccacccnccaagcctcctccnccgacaggaaactaacacgtccccggaccctacgaacgggtactacccgtacgagacgtacgtactttctctgcctacgtacccgaggtccgaagggaaacnccgaacacgtaccccgtcctacgaaccctattacgtcggacctaccgacgacgtacgaaccggacgaacggtctagtatttaacttactcgtactacgacgtactacggacgggacccgacccggtcctacggtaggttcgggtcgggtttcggggtttaccggggaccggggtacgggaacccgtaacggtccgttaccggtacccggtacggttacggtaccgaccggtaaccccgg

SEQ ID NO: 399149 - DNA, 740 bp, Homo sapiens
  misc_feature: GZ8MTXP02JVVIJ.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactggaacaacaacaatgttgcacgacgagtcgttggctgcagcagcacaggccaccctccaagcctcctcgtacccgacacggaataacactcccggccctacgaggactcctacagagagtattcctatcgcaatcccgagtcaaggaacgccaacgaacgtcccctacccgtacggaaccctaagtttaacccgtacgggtaaccttaccccgaaacgggcccttacgggaaacccggaaacggaaacggtacccgttaaggaactttttaaacttaaaccgttcgtacccgtttaacccgtaaggtacccgaaggtttaaccggggaaacccgaaacccccgggggtcccctttaacccggaaagggtttacccggggtaccggggtttacggggggttttttcccggggaccgggggtaaccggggtaaccccggaaaaacggggttccccgttaaacggggtaacccccggtttaaccccggtaacggggtttaccccggtaaccggtaaaccccccgggg

SEQ ID NO: 399150 - DNA, 661 bp, Homo sapiens
  misc_feature: GZ8MTXP02HD1YI.10.1.A01.1.454.CMB.2.raw
  modified_base (222)..(222): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctctcactcactctgcagtgtcagtggtccaggcagggctgactcagccacctggtatccaaggacttgagacagaccgcacactcacctgcacgtaggaacaanaacatgtacgcacgacggtagtcgttggctgcagcagccacacggccacctccagcctacctcgactaacgagaactacacgttccccggaccgtacaggggtacctacccgtacgaagtacgaacgtctttacacgtcggtacacgtttacccggaaggtaccgtaaagggacgaccctaaaccgaccgtacccttacccgacggtacctaacgtttaccggcggtaactccgaggttaccacggaacgtaccgtaagccttagtactttacgtaactcggtaaccacgacgtacgtacggtaccggaccgtacccggtacgtaccggtagggttcggttaccgggtttcggggttaccgggaaccgggtaacggaacccgtaacggttacccggtaccggtacccggtaaccgtacccggtaccgaacccggtaccg

SEQ ID NO: 399151 - DNA, 558 bp, Homo sapiens
  misc_feature: GZ8MTXP02FLAF8.10.1.A01.1.454.CMB.2.raw
  modified_base (400)..(400): a, c, t, g, unknown or other
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggcccacccctccaacgcctcctctccgacaggaaactaaccacgtcccggccctcgacggggactcctcgagagagtattctctcgcatccagtcaaggacgcacacgccctccctagaccgattacgngacctccgaggactgaacgacgaagctagtatttatactcgctacagcgagtacgggaccaccggcctacgagtcggtcggttcgggggtttcgggacgggacgggtaaccgaaggtccgtacggtacccgtccgttacggtaccgacggaaccccgg

SEQ ID NO: 399152 - DNA, 674 bp, Homo sapiens
  misc_feature: GZ8MTXP02FI6I0.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacacgaccgccacactcacctgcactaggaacaacaacaatgtggccacgacggagtcgttgctgcagcagccaccgacgggccccaccccgtcccaacgtcctccctcctacccgacaacggaaactaaccacgtcccggaccctacgagggtctccctacgagacgtagtacttccgtctcgacacgtccgagtacgaaggaacgcacgacgtcccgtcccgtacgtacctattaccgaggtacctccgaggacctacggaaaccgacgaacgtcgtagtatttaacgttacgtacgtaccttaccgaaggtaccgtacgggttaccggtaacccgaacccggtcccgttacggtaacggttcggggtttccggggtttacgggggttttacccgggacggggtaaccggggtaaacccggtaaaggtcccggtaaccggtacccggttaccggtaaccggtaccggaccgtaaccccggg

SEQ ID NO: 399153 - DNA, 740 bp, Homo sapiens
  misc_feature: GZ8MTXP02JOJS3.10.1.A01.1.454.CMB.2.raw
tcagcatagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcactgcactaggaacaacaacaatgtcgacacgacggagtcgttgctgcagcagcaccgaggccacccctccaagcctcctcctaccgaacaacggaataaacgacgtcccggcccctacgaagggactccgtacaagtacgaacgtactttacctactcgctaacgttacccgagggttaccgaaggaaacgaccaacccgaccgtaccccctaccccgttacaaaccccgtaactttaaccgtaccgggaaccctttaccccggaacggtaccgttaacggaaacccggtaaaccggtaaaccgaccgttaaggttaaacccttttaaagtttaacctacgtaccgttaaccgtaggacctaagggttacccgggaacgaacccccggtccgttaacgaacggtccgggttaaccgggtttcgggggttttaacccggggaaccggggtaaccggggtaacccgtaaacggtcccggtttaaccggaccccggttaccgttaccggggtaaccgaaccggttaacccccggg

SEQ ID NO: 399154 - DNA, 811 bp, Homo sapiens
  misc_feature: GZ8MTXP02IML56.10.1.A01.1.454.CMB.2.raw
  modified_base (254)..(254): a, c, t, g, unknown or other
tcagcatagtagtgcacgaccggtgctcgatttagacgtctcatcaggggtccaaacagagcttcagcaagcatagtgggaatctgcaccatgccctgggctctgcctcctcctgaccctcctcactcactctgcagtgtcagtggtccaggcagggctgacctcacgcccacccgtcggtactccgaaggacttgacgacacgaccgccacacctcaccgtgacactaggaacaacaacaagtgtcgcacggnggtagtcgtgcgtgcagcacgccgaccgcggaccccacccctaccgaaccgtccttccccgtacctaccccggaaacgaacggtaaaactaaccgaccgttcccccgggaccccttaccggaacggggtacttccccgtaccgaaggtaaccggtaacgttaactttcctaacgttccggacctaacgtacccggtaacgggtacgaaacggaacggaccctaacgtacccgtaccccgtacccttaaccgacccgttaacgttaccgtacgggtacccgtacccggtaacggtaccgtacggaaaccggaaccggaaacgtacccgtattaaactttacgttaaccgtaccggtaccacgtacgtacgtacgggttacccggggactaccccggggtaaccttccggtacgggtcggggttttaaacccggggttcgggggttttaccgggggaccgggggtaaccgggtaacccggtaacggggtacccggtttaacccggtaccccggggtttaccggaaccgggtttaccccggaccggtaaaacccccgggg

SEQ ID NO: 399155 - DNA, 541 bp, Homo sapiens
  misc_feature: GZ8MTXP01DFWMC.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaaatatgtgcagtggtaccagcagccgcccgggcacgttccccagaactgtgatctatgaagatactgtcacgacccctccgggactcccctgactcggttctcgtggcctccgtcgactacgttccctaccaactctcgccctccctcaccattctctgactgacgctgaggacgagggggtcaacttactactgtcacttcttatgtatgactatttaatggaggtcgaagttacgttcgggacgggagggaacgaaagggtgaaccgtgacgttaggtcgaacgaacccg

SEQ ID NO: 399156 - DNA, 622 bp, Homo sapiens
  misc_feature: GZ8MTXP01ELIC0.17.40.D07.1.454.CMB.2.raw
  modified_base (229)..(229): a, c, t, g, unknown or other
  modified_base (282)..(282): a, c, t, g, unknown or other
  modified_base (308)..(308): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtggtcggggtctccggggaagacaataaccatctcctgccacccgnagcagtggcaacattggcagccaatatgtgcagtggaccagcagccgcccggnacgtccccagactgtgatctatgaanatactgtacacgtccctccgggactcccctgacgtcggttctcgtcggtcctccgtcgacctacgtttccccacaactcctcctccctcccacacctatcctcgtcgactacgacgaccgtggaacgggaccggtaggggggtactaaccttacttaacgtcgtacctacctttacttagtgtattaccgtaacttaattttaagaggttaggtaccggttaagttacgggttaccgggacggggttaacgggaaaccgtaaaggggtccgtaacccggtggtacgttacgggtcccgaacggtaacccccggg

SEQ ID NO: 399157 - DNA, 613 bp, Homo sapiens
  misc_feature: GZ8MTXP01CQTRC.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtgtcggggtctccggggaagacaataaccatctcctgccacccgcagcagtggcaacattggcagccaatatgtgcagtggtaccagcagcgccccggcacgttccccagaactgtgatctatgaagatactgtacacgccccgtcgggacctcccgtgtacgttccggttctcgtcggcctccgtacgacctacgttccctaccaactcctcgtccctccctccacctatcctcgttcgactcggacgtacgtggagggtacggagggggttactacgttactacgtcgtacctacttcttaagtgtaatacgtaacttagtttaagtggttagggtacgttagttaacggttcggggaccgggttaagggaaccgtaaaaggggtcgtaaccggttaggacgttacgggtaaccgaacggaaccccgg

SEQ ID NO: 399158 - DNA, 569 bp, Homo sapiens
  misc_feature: GZ8MTXP01EK6ZV.17.40.D07.1.454.CMB.2.raw
  modified_base (257)..(257): a, c, t, g, unknown or other
  modified_base (485)..(485): a, c, t, g, unknown or other
  modified_base (493)..(493): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtggtcggggtctccggggaagacaataaccatctcctgccacccgcagcagtgcaacattggcagccaatatgtncagtggtacagcagcgcccggcacgttccccagactgtcgatctatagaagatacgtgtaccacggaccccgtccgggacctcccctgtacgtcggttctcgtggtcctccgtccgactacgttccctaccaacttctccgtccctccctacacctatcctacgtgactgacgactggacggacggagggggtacacttactactgtccacttctatgtatacgtatntttaaggnggacggtagttagtacgggtacgggacgggaaggaacggtaaggtcgaacggtgacgttacggtcgaaccggtccg

SEQ ID NO: 399159 - DNA, 608 bp, Homo sapiens
  misc_feature: GZ8MTXP01BQBO9.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgccacccgcagcagtggcaacattggcagccaatatgtgcagtggtaccagcagccgcccggcacgttcccctagaactgtgatctatgaagatactgtcacgaccccgtccgggacctcccgtgtacgttcggttcctccgtcgggccctcccgtccggtacctaccgtttcccctaccgtaaaccttcctccgtcccctccccttccaccctacttcctaccgtggaccttcggaaccgtacgtggaacgggtacggtagggggtactaacgttactactgtccacttacttatgtattacgacttattaagtggaggtacttagtacgttcgggacgggacgggaacgtaagggtcgtaacggtgacgttacgtcgaacgtaacccg

SEQ ID NO: 399160 - DNA, 643 bp, Homo sapiens
  misc_feature: GZ8MTXP01AS3T8.17.40.D07.1.454.CMB.2.raw
  modified_base (202)..(202): a, c, t, g, unknown or other
  modified_base (227)..(227): a, c, t, g, unknown or other
  modified_base (416)..(416): a, c, t, g, unknown or other
  modified_base (525)..(525): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaanacaataaccatcctcctgcacccgnagcagtggcaacattggcagccaatatgtgcagtggtaccagcacggccggccccgggcacgttccccaagaactgtgatctatgaaagatactgtcacgaccccgtcgggacctcccgtgtacttccggttctcgtcggcctccgtcgacctacgttccctaccaactcctcgtccctccctcacctnttctcgtggactcggacgacgtggaacggacggtaggggggttacaaccttaacgtacgttcgtacctacttactttaagtggtaacttagtaaccttaagttttaagngggttacgggtaccgttaagttaacgggttccggggacggggttaaacgggttaacggtaaaacggggttcggaacccgggtggtaccggttaacgggtccgaaaccggtcccccggg

SEQ ID NO: 399161 - DNA, 707 bp, Homo sapiens
  misc_feature: GZ8MTXP01BD130.17.40.D07.1.454.CMB.2.raw
  modified_base (600)..(600): a, c, t, g, unknown or other
tcagcgtagactagcacgaccggtgctcgatttagtgatagagcgtaacaacagagggggcaggggcctctgagagaaaaggtcttcaccatggactggacctggagggtcttctgcatgctggctgtaattccaggtactcactgtcaggtgcgtctgatgcagtcgtgggctgaggtcaagaaccgtgggcctgagtgaaggtttcctgacgaaggcgtcggatacaccttcactagcctcccatctgcacgtgggtcgcggcacggcccctagggaccaagggtcttggaggttgggttagggaactttacgtaccttaacccctttagtacgaaacctaaagtacggacgtaaccgttaccggtaccgaccgtaaaccgggtaaacgttttcggaacgggggtacccaacgggtacgttaccctaaccgttccgtaaacggaaccccgtaagggtcggaaaccggtacccggtaacccggaaaccgaacccaacgtacgtacctaaccgagtacgggagaccgttaggaacggtacgtagacgtaggaaagtagttaggaacgaccggacggtaccgtagtttagttagttttggngtacggaagtacgtacgtacggtacggtggggcaaggcgagccgtacggacgttacgggcgttaggtcggggaccgtaacgggacccgtgacgtccgttcgtccccg

SEQ ID NO: 399162 - DNA, 652 bp, Homo sapiens
  misc_feature: GZ8MTXP01B2NF9.17.40.D07.1.454.CMB.2.raw
  modified_base (162)..(162): a, c, t, g, unknown or other
  modified_base (203)..(203): a, c, t, g, unknown or other
  modified_base (284)..(284): a, c, t, g, unknown or other
  modified_base (302)..(302): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttangctgactcacgcccctctctgtggtcggggtctcggggaanacaataaccatctctgccaccgcagcagtggcaacattggcagccaatatgtgcagtggtaccagcacggccgccccgggntacgttccccagaactgngatctatgaaagtatactgtaccacgtaccccgtccgggtaacctccccgtagacgttccggttctcgtcggtcctccgtacgactacgttccctaccaactcctcgccctccctacacctactctccgtagactacgacgtacgaggaacgggtacggagggggttactaaccgttaactaccgttagtcctaaccttcttaagtacgtattaccggtaaattaagttttaagacggttaaggggtaccttaaagttacgggttaacccggggaggggttaaacgggaaacgtaaaggggtccgtaacccggttggaccgttaacgggtccgaacccgggtaaccccgg

SEQ ID NO: 399163 - DNA, 583 bp, Homo sapiens
  misc_feature: GZ8MTXP01DW6ER.17.40.D07.1.454.CMB.2.raw
  modified_base (199)..(199): a, c, t, g, unknown or other
  modified_base (223)..(223): a, c, t, g, unknown or other
  modified_base (249)..(249): a, c, t, g, unknown or other
  modified_base (252)..(252): a, c, t, g, unknown or other
  modified_base (409)..(409): a, c, t, g, unknown or other
  modified_base (472)..(472): a, c, t, g, unknown or other
  modified_base (501)..(501): a, c, t, g, unknown or other
tcagcgtagactagcacgaccggtgctcgatttagtgatagagcgtaacaacagaggggtggtagctcaggaagcagagcctggagcatctccactatggcctgggctccactacttctcaccctcctcgctcactgcacaggttcttgggccaactttatgctgactcagcccctctctgtgtcgggtctccgggaanacaataaccatctcctgcacccgnagcagtgcaacattggcagccaatangtncagtggtaccagcaggccgcccgggcacgttccccctagaactgtgatactatgaagtatacgtgtaccacgaccccgtccggactcccctgactcggttctacgtcggtcctccgtcgaactcgttccaacctactctcgtccctccctcgacctntctcgtcggactcggacacgtagagggaccgtagggggtctacgtaactcgtctacctacttnttaagtgtactagtacctaagtttaacgnggaggtcgttaaagttcggtacgggacggttaggaaccgtaaggtcgtaacggtgacgttacgggtaaccaacgaaccccgg

SEQ ID NO: 399164 - DNA, 618 bp, Homo sapiens
  misc_feature: GZ8MTXP01ELJJU.17.40.D07.1.454.CMB.2.raw
  modified_base (458)..(458): a, c, t, g, unknown or other
  modified_base (505)..(505): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtggtcggggtctccggggaagacaataaccatctcctgccacccgcagcagtggacaacattggcagccaatatgtgcagtggaccagcacgccgccccgggctacgttccccagaactgtagatctatagaagtatactgtacacgaccccgtccgggtactccccgtagtacgttccggtttctcgtcgggccctccgtaccgacttaccgtttcccctaccaaccttcctccgtccctcccctacacctatctacgtagtaatcgactacgnggaacggacggtagggggtactaacttactacgttcgtcctaccttnttatgtatagtactaagtttaagtaggaggtcgttagttacgggttcggggacgggaaaggggaacgtaaagggtcgtcgtacggtacggttacggtaaccgaacgaacccgg

SEQ ID NO: 399165 - DNA, 608 bp, Homo sapiens
  misc_feature: GZ8MTXP01D0QCB.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctccaccctcctcgctcactgcacaggttcttgggccaactttatgctgactcacgcccctctctgtggtcggggtctccggggaagacaataaccatctcctgccacccgcagcagtggacaacattgggcagccaatatgtgcagtggtaccagcagccgcccggcacgttccccagactgtgatctatagaagtatactgtacacgacccgtccgggactccccgtgacgttccggttctcgtcggcctccgtcgactacgttcccaccactctcgtccctccctcgacctacttctcgtcgtactcgaccgtacgtgggaacggacggtagggggtactaacttaccgtacgtcgttaccactttcgttaagtgtaattcgtaacttagtttaagtagggagggtacttaagttacggttcggggacgggttacgggaacgtaaagggtcgaaccgtggacgttacgggtccgaaccgtaaccggg

SEQ ID NO: 399166 - DNA, 686 bp, Homo sapiens
  misc_feature: GZ8MTXP01B0FAB.17.40.D07.1.454.CMB.2.raw
  modified_base (541)..(541): a, c, t, g, unknown or other
  modified_base (553)..(553): a, c, t, g, unknown or other
tcagcgtagactagcacgaccggtgctcgatttagtgatagagcgtaacaacagagggggcagggcctctgagagaaaaggtcttcaccatggactggacctggagggtcttctgcatgctggctgtaattccaggtactcactgtcaggtgcgtctgatgcagtcgtgggctgaggtcaagaaaccgtgggcctcgagtgaaggtttcctgcgaaggcgtcgggataccaccttcactacgcctcccatctgcacgtgggtcgcggcacggcccctaggacgaagggcttggaggtggttagggaatttacgtcttacccttagtacgaactaaagtcgctacgtccggtacgactaacggtaacttcgacgggaccagtagtcaactcgtaacgacctgtagacgtacgtacgaaccgtaccacgtacgtactaacaggtacggacgtactagggaagagttacgacgtaggaaacgtagttagggacggtaacggacgggtactagttaggtttagtttaggcggtagaaggttacgngggtacgtaggnggggaactaacgggctacgggttcggtaccgggtaacggttaacggggttccggttaacggggttaacccgggggacccgtaaaccgggggtacccccggtgttaacccgggtccgtttaacccgtccccggg

SEQ ID NO: 399167 - DNA, 629 bp, Homo sapiens
  misc_feature: GZ8MTXP01DHDE6.17.40.D07.1.454.CMB.2.raw
  modified_base (257)..(257): a, c, t, g, unknown or other
  modified_base (401)..(401): a, c, t, g, unknown or other
  modified_base (534)..(534): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtgtcggggtctccggggaagacaataaccatctcctgccaccgcagcagtggcaacattggcagccaatatgtncagtgacagcagccggccccgggctacgttcccctagaacctgcgatctatgaaagtatactgtaccacgtccccgtccgggactcccctgtacgttcgttctcgtcggctcccgtacgacctcgttcccctaccacttctccnccctccctacacctatccctagtcgggtaactgaccgacgttcggaacgggtacgggtaggggggtactaacctttaaccgtcgttacggtacctaacgtttcttaagtgtattagtaacttaggtttaaggnggttacggtacgttagttacgggttacggggaagggttacgggaacggtaagggtcggtaacggtcgaccggttacggtccgaaccggtaacccg

SEQ ID NO: 399168 - DNA, 648 bp, Homo sapiens
  misc_feature: GZ8MTXP01DWOG7.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaacttttatgctgactcagcccctctctgtgtcggggtctccggggaagacaataaccatctctgccacccgcagcagtggcaactattggacagccaatatgtgcaggtcgtaccagcagccgccccggacacgttacccctaagaactgtagatctatgaagtatactgtacacgaccccgtacgggacctcccgtgtactccggttctccgtcggtcctccgtcgaacctacgttcccctacctaacgttctcctccctccctaccaccgtactcctcgttacgactcgaacgtccgaggacggacggtagggggtactaacgttactaacgttcgtactaccttacttacgtagtaatacgaaacctttgttttaacgtacggacgggtaacgttagttaacgggttcggggaaccggggttaaggggaaaccggtaaagggtcccggtaaggttcggaccgtttacggtaaccgaaccgtaaccccggg

SEQ ID NO: 399169 - DNA, 592 bp, Homo sapiens
  misc_feature: GZ8MTXP01DZRF4.17.40.D07.1.454.CMB.2.raw
  modified_base (204)..(204): a, c, t, g, unknown or other
  modified_base (241)..(241): a, c, t, g, unknown or other
  modified_base (255)..(255): a, c, t, g, unknown or other
  modified_base (258)..(258): a, c, t, g, unknown or other
  modified_base (499)..(499): a, c, t, g, unknown or other
  modified_base (505)..(505): a, c, t, g, unknown or other
  modified_base (511)..(511): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtggtcggggtctccggggaanacaataaccatctcctgccacccgcagcagtgcaacnttggcacgcaatangtncagtggaccagcagccgcccgggcacgtccccagaactgtcgatctatagaagatacgtgtaccacgaccccgtcggacctcccgtgtacgttcggttcctcgtcggtcctccggtacgaccgtacttcccaccctaacttctcctccctccctacacctactcgtactcgacgtagaaccgagtagacgggtaaccggtagggggtactaacttactacgttcgtacctacttatttagngtaatntacttnttaagtggacgtcgttaagttaggtccggagggaggaacgtaagggtcgaacgtcgtacgttggtccgaacggtaacccgg

SEQ ID NO: 399170 - DNA, 573 bp, Homo sapiens
  misc_feature: GZ8MTXP01AZ31R.17.40.D07.1.454.CMB.2.raw
  modified_base (204)..(204): a, c, t, g, unknown or other
  modified_base (228)..(228): a, c, t, g, unknown or other
  modified_base (240)..(240): a, c, t, g, unknown or other
  modified_base (251)..(251): a, c, t, g, unknown or other
  modified_base (253)..(253): a, c, t, g, unknown or other
  modified_base (339)..(339): a, c, t, g, unknown or other
  modified_base (391)..(391): a, c, t, g, unknown or other
  modified_base (399)..(399): a, c, t, g, unknown or other
  modified_base (427)..(427): a, c, t, g, unknown or other
  modified_base (493)..(493): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtgtcggggtcgtccggggaanacaataaccatctcctgccaccgnagcagtgcaacntggcagcaatngngcagtcgacagcacggccgccgggcacgtttccccagaactgtgatctaatgaaagatacgtgacacgaccctacgacggactccnggtacttcggttctcgtggccctaccgtcgactcgttccccacactcgtccnccctcccncaacctcgtcctctacgctcgactacgnggacggacgggggtaggtactaactaacttctgtcctaacttcttagtgtatatattaagttaggnggtacgagtacgtacgggttacgggacgggaacgggtaacgaacgggtccgacgggtcgttacgtaacggaaccgtaacg

SEQ ID NO: 399171 - DNA, 520 bp, Homo sapiens
  misc_feature: GZ8MTXP02JYTRG.17.40.D07.1.454.CMB.2.raw
  modified_base (373)..(373): a, c, t, g, unknown or other
  modified_base (456)..(456): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaagatactgtcagaccctccgggactccctgatcggttctctggctccgtcgacagttcctcaactcncgccctccctcaccactctctcggactcgacgactgaggacggagggtcgactactactgtcactcttatgatgactatttangaggcgtagtacgttcgggacggagggaacaaggtcgaccggtcgacgtacggtcgacgacccg

SEQ ID NO: 399172 - DNA, 560 bp, Homo sapiens
  misc_feature: GZ8MTXP02JYPZS.17.40.D07.1.454.CMB.2.raw
  modified_base (199)..(199): a, c, t, g, unknown or other
  modified_base (344)..(344): a, c, t, g, unknown or other
tcagcgtagactagcacgaccggtgctcgatttagtgatagagcgtaacaacagaggggtggtagctcaggaagcagagcctggagcatctccactatggcctgggctccactacttctcaccctcctcgctcactgcacaggttcttgggccaactttatgctgactcagcccctctctgtgtcgggtctccgggaanacaataaccatctcctgcacccgcagcagtggcaacattggcagccaatatgtgcagtggtaccagcagcgcccgggcagttcccctagaactgtgatctatgaagatactgtcagacccctcgggactcccgtgactcggttcncgtcgctccgtctactacgttcctaccactctcgtccctccctccctaccactcctcgtcgtacgtcgaccgtacgtacggacggacggacgggtacgactactacgtcgtctacttacttactagtatagtactatttacgtagtaggacgtagtacgtacggtacgggacgggaacgaacggtacggtaccgtcgtacgtacggtacgacgccg

SEQ ID NO: 399173 - DNA, 540 bp, Homo sapiens
  misc_feature: GZ8MTXP02G1EQA.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcaccgcagcagtggcaacattggcagccaatatgtgcagtggtaccagcagcgccggcagttccccagaactgtgatctatgaagatactgtcagacccgtcggactccctgactcggttctcgtcggcctccgtcgaccagttccctaccaactctcgccctccctcaccatctctggactgacacgtgaggacgagggtcacgtactactgtactacttacttatgatagtactaattttacgaggtaggacgtaagttacgttcgggacggacgggtaaacgaaaggtcgaaccgtgacgtacgtaccgacgacccgg

SEQ ID NO: 399174 - DNA, 568 bp, Homo sapiens
  misc_feature: GZ8MTXP02HCW1N.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtgtcggggtctccggggaagacaataaccatctcctgccacccgcagcagtggcaacattggcagccaatatgtgcagtggtaccagcagccgcccggcacgtcccctagaactgtgatctatagaagtatactgtcacgacccctccgggacctccctgtactcggttctcgtggcctccgtcgactacgttcctccaactctccgtccctccctcaccacttctcgtcggactacgaccgacgtgacgggacgtagggtacgtactactactcgtactacttcttatgatagtactatttagagtaggacgtagttacgttcggggacggtaacgggtaacgtaacggtcgaaccggtcgtacgttacggacgacgtaacccg

SEQ ID NO: 399175 - DNA, 521 bp, Homo sapiens
  misc_feature: GZ8MTXP02H9481.17.40.D07.1.454.CMB.2.raw
  modified_base (466)..(466): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcacgttccccagaactgtgatctatgaagatactgtcagaccctcggactccctgatcggttctctgcctccgtcgactacgttccctcaactctcgccctcccctcacccatcctctcggactgacgactggaacggacggagggtcgacttactactcgtacacttcttatgatgactatttagngagctagtacgtcggacggaaggaacgaaggtcgacgtgcgtacgtcgacgaccg

SEQ ID NO: 399176 - DNA, 539 bp, Homo sapiens
  misc_feature: GZ8MTXP02JCH63.17.40.D07.1.454.CMB.2.raw
  modified_base (394)..(394): a, c, t, g, unknown or other
  modified_base (471)..(471): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtgtaccagcagcgcccgggcagttccccagaactgtgatctatgaagatactgtcacgaccctcgggactccctgatcggttctcgtcggctccgtcgactacgttccctactaactctcgccctccctcaaccnctctctcggactgacgactgacggacggagggtgtactactactgtcctactcttatgagtacgactatttaacggnggtaggtacgtagttacggtcgggacggtacggaacgaaggtcgacgtcgtacgtacgacgacgaccg

SEQ ID NO: 399177 - DNA, 665 bp, Homo sapiens
  misc_feature: GZ8MTXP02HBUYK.17.40.D07.1.454.CMB.2.raw
  modified_base (228)..(228): a, c, t, g, unknown or other
tcagcgtagactagcacgaccggtgctcgatttagtgatagagcgtaacaacagagggggtggtagctcaggaagcagagcctggagcatctccactatggcctgggtctccactacttctcaccctcctcgctcactgcacaggttcttgggccaactttatgctgactcagcccctctctgtgtcggggtctccggggaagacaataaccatctcctgccacccgnagcagtggcaacattggcagccaatatgtgcagtggtaccagcagccgccggcagttccccagaactgtgatctatgaagatactgtcacgacccgtcggacctcccgtgacgtccggttctcgtcggcctccgtcgacctacgttccctcctaacctctcgcccctccctccacctacttccctcttcgggacttcggaaccgtacgtacgggaaacggggtaaccggtacgggggttactaaaccgttacccgttaccgttacgttacccgtaccttttaccgtttaagttaccggtaagttaccgtaaactttaagtttttaacgacgggttaacggtaccgtaaagttaaacggtttccggggacggggtaacgggtaacgtaaaacggggtcgtaacccggtggtacgtacggtaccgaccggtaaccccgg

SEQ ID NO: 399178 - DNA, 560 bp, Homo sapiens
  misc_feature: GZ8MTXP02GCZQM.17.40.D07.1.454.CMB.2.raw
  modified_base (211)..(211): a, c, t, g, unknown or other
  modified_base (365)..(365): a, c, t, g, unknown or other
  modified_base (455)..(455): a, c, t, g, unknown or other
tcagcgtagactagcacgaccggtgctcgatttagtgatagagcgtaacaacagagggggcaggggcctctgagagaaaaggtcttcaccatggactggacctggagggtcttctgcatgctggctgtaattccaggtactcactgtcaggtgcgtctgatgcagtctggggctgaggtcaagaaacctggggcctcagtgaaggtttccngcaaggcgtcgggatacaccttcactagctcccatctgcactgggtgcggcacggcccctggacaaggcttgagtggtaggaattatctacccttatgacaatagcacgtcggtacgcacgtaacttcgagggccagacgtcactctacgaccngtgagtaccgtcgaccaacacagtactacagtgaagcgtagagatgctagaagtagtaggaacggacacggtaccaattgttaattttgngacgtagagtgtacggtagtggggacacggcacggccgtacggaaccgtagggcgtacggttcggggacccgtaacggggaaccccgtgacgtccgtccgtcccg

SEQ ID NO: 399179 - DNA, 696 bp, Homo sapiens
  misc_feature: GZ8MTXP02GATTR.17.40.D07.1.454.CMB.2.raw
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccggcagttcccctagaactgtgatctatgaagatactgtcagaccccgtcgggacctcccgtgactcggttctcgtcggcctccgtcgacgtacgttccctacctaaactctcgtccctcccctcaccctattcctcgtacgggtactcggaaccgtaccgtggaaacggggtaacccggtaagggggttccggtaaaccgttaaaccttacccgtttacggtacccgtaaccgttaccttttaacgtacggtaattacggtaacctttaaagttttacgtacgggtaaaggggttaccgtaaaggtttaacggtttacccgggggtacgggggaaacgggggtaaaaccgtaaaaggggttacggggtaaaccccggttggtaccggtttaaacggtaccgtaaccggtaaacccccggg

SEQ ID NO: 399180 - DNA, 621 bp, Homo sapiens
  misc_feature: GZ8MTXP02JUT31.17.40.D07.1.454.CMB.2.raw
  modified_base (201)..(201): a, c, t, g, unknown or other
  modified_base (302)..(302): a, c, t, g, unknown or other
  modified_base (305)..(305): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtgtcgggtctccgggaanacaataaccatctcctgcacccgcagcagtggcaacattggcagccaatatgtcgcagtcggtaccagcagccgcccggcacgtttccccagaactggtanatntatagatatactgtacacgacccgtcggaccctccgtgtacgttcgtcgtcgtcgtccgtaccgtcgacctaccgttcctacctactcctcctccccttccctaccctaccgtcttccgtcgtacggtacgtacggaccgtaccgtaggaaccggggtacggtagggttacgtaacttacgttacgtacgtacctaaccgtttattaagtgtaacgttagtaacttaggttacgacggaggtacgtaagttacggttaccggggacgggaacggtaaacgtaacggtcgtacggtcgacgttacgacgacgtaccg

SEQ ID NO: 399181 - DNA, 641 bp, Homo sapiens
  misc_feature: GZ8MTXP02IWERP.17.40.D07.1.454.CMB.2.raw
  modified_base (244)..(244): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctctctgtggtcggggtctccggggaagacaataaccatctcctgccacccgcagcagtggacaactnttggcacgccaatacgtgtgctagtcggtaccagcagccggcccggcctacgttacccctagtaacgtgtagactactagtagaagtactactgtaccacgacccgtccggacctcccgtagtacgttccggttctccgttcggccgtccgtacgtacctaccgttccctacccaacttcctaccgtcccttaccctccacctacgttcctcgtacggacttacgaccgtagtacggacgggtacggtagggtacgttaacgtaccttactaccgtactacttacttagacgtagtagtactagtttacgagtacggtactagtacggtacgggacgggaacgggaacgtaacgggacggtaacggtcggacgtacggtaccggaccgtaacccggg

SEQ ID NO: 399182 - DNA, 648 bp, Homo sapiens
  misc_feature: GZ8MTXP02JZ1A0.17.40.D07.1.454.CMB.2.raw
  modified_base (195)..(195): a, c, t, g, unknown or other
  modified_base (209)..(209): a, c, t, g, unknown or other
  modified_base (318)..(318): a, c, t, g, unknown or other
  modified_base (378)..(378): a, c, t, g, unknown or other
tcagcgtagactagcacgaccggtgctcgatttagtgatagagcgtaacaacagagggggcaggggcctctgagagaaaaggtcttcaccatggactggacctggagggtcttctgcatgctggctgtaattccaggtactcactgtcaggtgcgtctgatgcagtctggggctgaggtcaagaacctgggcctnagtgtaaggttccngcaaggcgtcgggatacaccttcactagctcccatctgcacgtgggtcgcggcacggcccctggaccaagggcttggaggttggttaggtaatttactcctaacctttnacgaactaatacgctacgtcggtacgcacggtacttcgaggacagagtcactctacgacngtgacgaccgtacgacgaccacgagtacctacgagtcgggtaacgcgtagaggtatcggacgtagtaaagtagttaggacggaccgacgtccgtagttaggtttacttttgcggtacgaaggtacgtagtacggtaggtacggggtacgaggaccgacggtacccggttaccggggaaccgttacgggacggttaacggggttccgggggaaccccggtaaccgggggtacccccggtaacgtccggtacccggttcccgttacccccgg

SEQ ID NO: 399183 - DNA, 528 bp, Homo sapiens
  misc_feature: GZ8MTXP02JKBBH.17.40.D07.1.454.CMB.2.raw
  modified_base (308)..(308): a, c, t, g, unknown or other
  modified_base (328)..(328): a, c, t, g, unknown or other
  modified_base (363)..(363): a, c, t, g, unknown or other
  modified_base (443)..(443): a, c, t, g, unknown or other
  modified_base (514)..(514): a, c, t, g, unknown or other
tcagcgtagactagcacgaccggtgctcgatttagtgatagagcgtaacaacagagggggcaggggcctctgagagaaaaggtcttcaccatggactggacctggagggtcttctgcatgctggctgtaattccaggtactcactgtcaggtgcgtctgatgcagtctggggctgaggtcaagaaaccgtgggcctcagtgaagtttcctgcaaggcgtcgggatacaccttcactagctcccatctgcactgggtgcggcaggcccctggacaagggcttggagtggtggaattagtctacccttangaacaatagcactcggtacncacggactttcgaggtccagagtcactcgtgaccngtgagacgtcgacgacacagtcacagtgagctagagatgctagaagattagaggtacacgggtccagttgttaattttgngagagagactggagtggggcagcgaacgcgtcggaccgtaggcgtaagtcggggacctacggggaccccgngacgcgtctcccgg

SEQ ID NO: 399184 - DNA, 653 bp, Homo sapiens
  misc_feature: GZ8MTXP02H7VCB.17.40.D07.1.454.CMB.2.raw
  modified_base (203)..(203): a, c, t, g, unknown or other
  modified_base (228)..(228): a, c, t, g, unknown or other
  modified_base (270)..(270): a, c, t, g, unknown or other
  modified_base (311)..(311): a, c, t, g, unknown or other
  modified_base (422)..(422): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgcctgactcacgccctctctgtgtcggggtctccggggaanacaataaccatctcctgccacccgnagcagtggacaacattggcagccaatatgtgcagtggtaccngcagccggcccggcacgttcccagaactgtgatctatgaantactgtcacgtaccccgtcgggtacctcccgtgtacgttccgttctcgtcgggtcctcccgtacggtacctacgtttcccactaaacttcctacgtccctcccctcaaccngttctcgtacgacttcgaaccgtatgggaaggaccggtaggggtaccgaacttacccgttacgttacgtacctaccgttacttaactacggtatagtaaccttaagtttaacggtaggaggtaccggttaagtaccgggtttaccgggaacgggggtaacggaaacggtaaacggggttaccggtaacggttaccgggacgtttacggggaacctaaccgggtaaccccgg

SEQ ID NO: 399185 - DNA, 608 bp, Homo sapiens
  misc_feature: GZ8MTXP02JG6VT.17.40.D07.1.454.CMB.2.raw
  modified_base (200)..(200): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgccctctctgtgtcggggtctcgggganacaataaccatctcctgcacccgcagcagtgcaacattggcagccaatatgtgcagtggtaccagcagccggccggcacgttccccagaacgtgtgatctatagaagtatactgtcacgaccccgtcggtaccctcccgtgtacttcggttctcgtcggtcctccgtcgactacgttcccacctactctcgtccctccctcacctctctcgtcgacgtcgacgactcgagggacggtaggggtactacttactacgtagtcctacttacttacgtgtacttagtaactagtttacgaggtacgggtactacgttacggttaccggggaccgggggtaagggaaaccgtaaaggggttacgtaaaccggttcggtaacggtacggttaccggaacccggtaaccccggg

SEQ ID NO: 399186 - DNA, 592 bp, Homo sapiens
  misc_feature: GZ8MTXP02H5N1I.17.40.D07.1.454.CMB.2.raw
  modified_base (179)..(179): a, c, t, g, unknown or other
  modified_base (228)..(228): a, c, t, g, unknown or other
  modified_base (292)..(292): a, c, t, g, unknown or other
  modified_base (422)..(422): a, c, t, g, unknown or other
  modified_base (498)..(498): a, c, t, g, unknown or other
tcagcgtagactagcacgaccggtgctcgatttagtgatagagcgtaacaacagagggggtggtagctcaggaagcagagcctggagcatctccactatggcctgggctccactacttctcaccctcctcgctcactgcacaggttcttgggccaactttatgctgactcacgcccctntctgtgtcgggtcgtaccggggaagacaataaccatctcctgcacccgnaagtcagtgacaacattggcagaccaatatgtagcaggtcggtaccagcacggccgacccgggntaccgtttccccaaggtaacctgttagatctagtaggaaatactatacgtcaaccggtacccccgtcgggacctccctgtacctcggttctcgtgcctccgtacgacctacgttcccactaacgttcccncctccctacctacactactccgtatagactacgacgacgaggacggacgtagactaactactcgtatactacgttntatagtatatatattagtaggtagtacgtagtacgtacgggtacgggaacggaaggtaacggtacggtacgtacgtacgtacgtacgacgaccg

SEQ ID NO: 399187 - DNA, 616 bp, Homo sapiens
  misc_feature: GZ8MTXP01DW92X.4.67.G01.1.454.CMB.2.raw
  modified_base (208)..(208): a, c, t, g, unknown or other
  modified_base (267)..(267): a, c, t, g, unknown or other
  modified_base (284)..(284): a, c, t, g, unknown or other
  modified_base (309)..(309): a, c, t, g, unknown or other
  modified_base (314)..(314): a, c, t, g, unknown or other
  modified_base (318)..(318): a, c, t, g, unknown or other
tcagagcactgtagcacgaccggtgctcgatttagagtatacatattgggtttgggtctgagagaggagcccagccctgggattttcaggtgttttcatttggtgatcaggactgaacagagagaactcaccatggagtttgggctgagcgtgcgtttctagtggctattttaaaaggtgtccagtgtgaagtgcagctggtggagtntggggaggcctggcacagccgggggtcccgtgagactctcctgtgcagcctctggattntagtagtatgtctgcangcgtcggcgcgcgcgtcgtggaggngtggngtgngtcgtgaggtagtagtcgcgacgtgcgtataaataactaataattaataacgacgtacgtacggtacggaacgggaccgtccgtacctacctactacctaccgaacgaacgaactaaactaaccgaaacgaaacgtaacgtacgtacgtactacgtaacgaaacgtaacgaacgaacgaccgtacggacgggaccggaacggacgaaccggaaccgaacttaataacttacgtacgtagaacgaacgacgtaacgtcggtcggtcgggtccggttccgggtccgggttaacggtaagg

SEQ ID NO: 399188 - DNA, 548 bp, Homo sapiens
  misc_feature: GZ8MTXP01DXH3R.4.67.G01.1.454.CMB.2.raw
  modified_base (304)..(304): a, c, t, g, unknown or other
  modified_base (313)..(313): a, c, t, g, unknown or other
  modified_base (350)..(350): a, c, t, g, unknown or other
  modified_base (369)..(369): a, c, t, g, unknown or other
  modified_base (381)..(381): a, c, t, g, unknown or other
  modified_base (457)..(457): a, c, t, g, unknown or other
  modified_base (470)..(470): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaagtgcagctggtggagtcgtgggggagcctggcacagccgagggggtccctgagactctcctgtgcagcctctggattcagtttagaatgtctgccatgacctggccncaggctcgngggagggctgggagtggatcgtgaggggtatttaggnggcagtgggctaaattatnaatagtttaaanacgagtacgtcggagacggctctacacatcacagacacaactacaacgaacgacgtaggtactacgtacgaacaanagaacgacgacgngagacgacgacgaacgacgacacacgtactacttgttagacgaagacgtcgtcggtcggttcggtccggttcggtcgg

SEQ ID NO: 399189 - DNA, 574 bp, Homo sapiens
  misc_feature: GZ8MTXP01AMVPF.4.67.G01.1.454.CMB.2.raw
  modified_base (276)..(276): a, c, t, g, unknown or other
  modified_base (311)..(311): a, c, t, g, unknown or other
  modified_base (319)..(319): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaagtgcagctggtggagtcgtggggggaggcctgggcacgagggccggggggggtccctggagactctcctgtgcagcctntggattcagtttagaatgtctgccatgactggccncagctcgngggagggctggagtggatctagaaggtatttagggcgcagtggactattaactataatacttatacgacgtaccgtacggaggaacggcctactacacctactccacgaagacaactaactaacaacgaacgtacgtagtacgtactacgtacaactaacgaacgacgacgacgacgagacgacggacgaacgacgacacttagtacgtagagacgacgaagtcgtcggtcggtcggttccggtcgggttcggtg

SEQ ID NO: 399190 - DNA, 628 bp, Homo sapiens
  misc_feature: GZ8MTXP01EUUOL.4.67.G01.1.454.CMB.2.raw
  modified_base (155)..(155): a, c, t, g, unknown or other
  modified_base (254)..(254): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgngtttctaggtggctattttaaaaggtgtcagtgtgaagtgcagctggtggagtctgggggaggcctggcacagccgggggggtccctgagctctcctgngcagctgtggtattctagttagtaatgtctcgcagtcgtaccgtcggtccgccgacggcgtcggtagggacgggtcggtggtaggtggtagtcgtcgtaggtagtaggtcggacgtacgtcggtacgtaattaaataactaattaattaaataacgtacgtacgtacggtacggtaacgggtaccgtaccgtacctacctactactacgtaacgaacgaactaactaacgaaacgaaacgtaacgtagtacgtacgtagtaactaaacgtaacgaacgacgacgtagacgacgacggacgacgaacgacactaattagtacgtgttagacgaacgtaagtcgtcggtcggtcggttccggtcgggttcggtaag

SEQ ID NO: 399191 - DNA, 680 bp, Homo sapiens
  misc_feature: GZ8MTXP01DLWUP.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttctgtggctattttaaaaggtgtccagtgtgaagtgcagctggtggagtcgtgggggaggcctggcacgaggccgggggggtccctggagactctcctgtgcagcctctggattcagtttagaatgtctgccatcgaccgtgggtcccgccgaggctccggtggggaagggctggagtggatctcgagggtattaggtcggcacgtgggacctagttaaactactaattatttataacagtacctccggtagaacggggccctcttccaccatcctaccgaagtacgaacctaactacccgaaagaaccgaacgggttagttaactccgttaggaacctaaaagtacggaaaacccaggtaccccgtaagggaacggtaaccggaccccggaaagggaaccccgaaccggggaccccaaaccgtaaagttaacgtttaaaccgtggttaggaccgaaaaaggtcttaccggtccgggggtccttacgggggttccccggtccgggggttcccgggttaagg

SEQ ID NO: 399192 - DNA, 575 bp, Homo sapiens
  misc_feature: GZ8MTXP01DFXU9.4.67.G01.1.454.CMB.2.raw
  modified_base (492)..(492): a, c, t, g, unknown or other
  modified_base (519)..(519): a, c, t, g, unknown or other
  modified_base (528)..(528): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccgggggggtccctgagactctcctgtgcagcctctggattcagttagaatgtctgccatgacctgggtcccgccaggctccgtggggaaggggctgggagtggatctcgagggattaggtggcacgtgggacgatttaaataacaattaatttaactaaacgagaaccttccggtaggaaacggggcccgtacttccaaccatcctacccaagacgaacaaacttccaaagaacacggtgtatactgacaaatgaacngcctagagagaccgagacaacggccanattattacngttgcgaaagaagtctcggggctgggttcccgcggttccggggtaag

SEQ ID NO: 399193 - DNA, 634 bp, Homo sapiens
  misc_feature: GZ8MTXP01AJJUM.4.67.G01.1.454.CMB.2.raw
  modified_base (513)..(513): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtggggggaggcctggcacgaggccgggggggtccctgagactctcctgtgcagcctctggattcagttagaatgtctgccatgaccgtgggtcccgccaggcctccgtgggggaagggggctgggagtggatcgtcgaggggtattaggtggcacgtgggacgtatttaactactaattattaatacagtacctccggtaggaaacgggcccgtcttccacctatcctacccagaacgaactaaacttacccgaaagaaaccgacgggttagtaacgtctaggaccaaaagtcggaaaccncgaccgtaggacgacggaccggaacggaacccgaaccggtaccaatacgttaacgttacgtaggacgacgaaagcttcggtccgggtcgttccggggttcccggtccggggttcgggtaag

SEQ ID NO: 399194 - DNA, 390 bp, Homo sapiens
  misc_feature: GZ8MTXP01B98WQ.4.67.G01.1.454.CMB.2.raw
  modified_base (384)..(390): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtctggggtcagcccaaggccaaccccatgtcactctcgttccccgccccctcctctacagtgctctgagcgggctggcaaggcgcatagnnnnnnn

SEQ ID NO: 399195 - DNA, 536 bp, Homo sapiens
  misc_feature: GZ8MTXP01BLICL.4.67.G01.1.454.CMB.2.raw
  modified_base (273)..(273): a, c, t, g, unknown or other
  modified_base (371)..(371): a, c, t, g, unknown or other
  modified_base (377)..(377): a, c, t, g, unknown or other
  modified_base (496)..(496): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctaattttaaaggtgtccagtgtgaagtgcagctggtggagtcgtgggggagcctggcacgaggccgggggggtccctgagacttctcctgtgcagcctctggnttcagtttagatgtctgccatgacctgggtccgcaggctccgtgggggaagggctggagtggatctagaggatttaggcgcagtggactattaacatntattanacagtctcggtagacggcctctccacatcacaagacactaactacaacgacgtagtatacgtctagacaaagacacgacgcgagagacgacgacgacgaacgacacattacgtacgtgngcgacgaagtcgtcggtcggtcggttcggtcggttcggtg

SEQ ID NO: 399196 - DNA, 554 bp, Homo sapiens
  misc_feature: GZ8MTXP01AD4IN.4.67.G01.1.454.CMB.2.raw
  modified_base (305)..(305): a, c, t, g, unknown or other
  modified_base (370)..(370): a, c, t, g, unknown or other
  modified_base (444)..(444): a, c, t, g, unknown or other
  modified_base (509)..(509): a, c, t, g, unknown or other
  modified_base (541)..(541): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggcttattttaaaaggtgtccagtgtgaagtgcagctggtggagtcgtgggggaggcctgggcacgaggccggggggtccctgagactctcctgtgcagcctctggattcagttagaatgtctgccatgacctgggtccnccaggctccgtgggaaggggctgggagtggatcgtcgagggattagtcggcacgtggcgattaanactaatattatacagtactccgtgaacgggccgcttcaccatctccagacacaattcccaaagaaccacgggtntaagtctagaccaaagtgaaaccgagccctagagacgccgaggcaacggcttacgattagttacngttgcgaagaatcgtcgggcttgggttcccgnggttcccggtaag

SEQ ID NO: 399197 - DNA, 823 bp, Homo sapiens
  misc_feature: GZ8MTXP01EL3M5.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtcgtgggggaggcctggcacgaggccggggggggtcccagtagacgtctcctcgtgcgacgcgtccctggagttacttagttaaggttaagtagttcgttcgtccgactagtaccgtccgggttccgggcccgacggcggtcccgtcgggaagggggacgggtggtagggtaggagtctccgtagggaggttagttacggcgaacgtcggtcggattaaattaactaattaattaatttaacacgtaacgtacccgttacgggaacgggtacccgggctttaccaaccaaaccttccttcccgtaaaccgaaggtaaacctaaactttacccgaaaaccgaaagtaaaccgggttaccgggttaaatttacggttccggtaaaacgtaaacgtaaacgaaaccgaaccgtaccgtaacgggtaacggaaaccgggtacccgggaacccggggtaaaccggaaaccccgggtaacccgaaaccgttaaacttaaacgtttaaaccggttcgggttaacgggttaaaccggaaaaacggtaagttccccggggttcccgggggttccgggttccggggtttaccccggggttaacccgggggttcccgggggttaagg

SEQ ID NO: 399198 - DNA, 724 bp, Homo sapiens
  misc_feature: GZ8MTXP01D5JGS.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctaattttaaaaggtgtccagtgtgaagtgcagctggtggagtcgtgggggaggcctggcacgaggcccgggggggtccctgagactctcctgtgcagcctctggattctagttagaatgtctgccatcgacctgggtcccgccgaggcctccgtagggggaaggggctgggagtggatcgtcgaagggattaggtcggcacgtggacgtaattaaactaataataattaactaacaacgtaaccgttccggagggaaacggcccgtacttaccaacctatccctaccgaaggacaaactaaacttaacccgaaaagtaaccgtaacgggttagtaataccgtagaaacaaagtacgaaaccacgtaccgaggaacgacggtaccccggaaaggggaacccaaaccgggttaccccaaacgtaaacgttttaactttaaacccggttacgggacggttaaaacggaaaaacgtaacggttccccgggtcccgggggttaccggttaccgggggtttacccccggggcccgggggttttaacccgggggttaaacggg

SEQ ID NO: 399199 - DNA, 587 bp, Homo sapiens
  misc_feature: GZ8MTXP01DGL9B.4.67.G01.1.454.CMB.2.raw
  modified_base (261)..(261): a, c, t, g, unknown or other
  modified_base (552)..(552): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttctgtggctaattttaaaaggtgtccagtgtgaagtgcagctggtggagtcgtgggggaggcctggcacgaggccggggggtccctgagactctcctgtncagcctctggattctagtttagaatgtctgccatcgacgtggtccgccgaggcctccggtggggaaggggtcgtggagtggatcgtcgagggtattaggtcggctacgtgggctaattaaatactaattattaataacgagtacctcggtagaacgggcctcttacacccatcctaccagactaactaacttaccaaagaacgacgtagtaactctagaacaaagtcgaaacgagccagagacgacgacggacaacggtccaagattacttaacgtgttacgacgaaagtntcgtcgggcgtcgggttccgcgggttccgggtaag

SEQ ID NO: 399200 - DNA, 690 bp, Homo sapiens
  misc_feature: GZ8MTXP01EF6T0.4.67.G01.1.454.CMB.2.raw
  modified_base (299)..(299): a, c, t, g, unknown or other
  modified_base (385)..(385): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggctttttctgtggctattttaaaaggtgtccagtgtgaagtgcagctggtggagtcgtgggggaggcctggcacaggccggggggtccctgagactctcctgtgcagcctctggattcagttagatgtctgccatgactggtccncaggctcgtgggaagggctggagttggatcgtagaggggtattaggtcggctacgtgggactaatttaacaactaattaatttaanaacgagtaccgtccgggtagggaaacgggccctctttaccaacctattcctacccaaagggaactaaactaaacttaccaaaacgaaaccgtaacgggttagttaagttccgtaggaaaccaaaactaagaaacgacgaccgtacgaaggaacggaccggaacgggaaccggaaaccgggaaccgaacctaaacttaacgtttaactacggttacggttaacggaaaaggtaaacgttaccggtccggggttccgggttaccggggttacccggggtccgggggttccccgggggtttaacgggg

SEQ ID NO: 399201 - DNA, 675 bp, Homo sapiens
  misc_feature: GZ8MTXP01D7SNZ.4.67.G01.1.454.CMB.2.raw
  modified_base (305)..(305): a, c, t, g, unknown or other
  modified_base (401)..(401): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctattttaaaaggtgtccagtgtgaagtgcagcgtggtggagtcgtgggggaggcctggcacgaggccggggggtccctgagactctcctgtgcagctctggattcagttagatgtctgccatcgaccgtgggtcccnccgaggctccggtgggaaggggctgggaggttggattcgtacgaggggtattaggtggcctacgtgggacctaatttaactaactaattaatttanaaccacgtaaccgtccggtagggaaacgggtccctacttaccacctaatcccgtaccaaagggtacaaacctaacttacccgaaaagtaacccgtagggtttgtaactaccggttaaagaaacctaaagtaaccgaacctacggtaccgtaaggaacggaccggacccggaacggaacccgaaccgtaccaataactttaacgttacgtagttacgaacgttaacgtcgtccgggtccgggttcggtccgggttccgggtccgggttcgggttg

SEQ ID NO: 399202 - DNA, 575 bp, Homo sapiens
  misc_feature: GZ8MTXP01BSK3N.4.67.G01.1.454.CMB.2.raw
  modified_base (308)..(308): a, c, t, g, unknown or other
  modified_base (377)..(377): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctaattttaaaaggtgtccagtgtgaagtgcagctggtggagtcgtgggggaggcctggcacgaggccgggggggtccctgagactctcctgtgcagcctctggattctagttagaatgtctgccatcgacctgggtcccncgaggctccgtggggaaggggctggagtggatctgagggtattaggtggcacgtgggactaatttaaanactaatattaatacagtacctcggtagaacgggccctcttacacctaatcctaccgaagacgaactaaacttaccaaagaaccgacgggttatatcgtagacaaatagaacacgaccgagagagacgacgacgaacggacacattatactgttagcgaagaagtcgtcggtcgtcggttcggtcgggttccggtaagg

SEQ ID NO: 399203 - DNA, 721 bp, Homo sapiens
  misc_feature: GZ8MTXP01DXX5G.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctggtggctattttaaaaggtgtccagtgtgaagtgcagctgggtggagtcgtgggggaggcctggcacgaggccggggggtccctgagactctcctgtgcagcctctggtattctagtttagaatgtctgccatcgacctgggtcccgccaggctccgtggggaagggctggagtggatcgtcgagggtattaggtcggcacgtgggactattaaatactaatatttaataacacgtactccggtggaaacgggtcctacttacacctatcctaccaaaggacgtaactaaacttacccgaaaagaaaccgtacgggtacgttaaagttccttaggaaacctaaaacttaggaaaacccgtacgtaaccgtaagggaacggtaaccgggacccggtaaacgggaacccgaaaccggtacccaaacgttaaacgtttaaacgtttaaccggtaggttaaacggttaaaccgggttaaaacggttccggttacccgggttccgggggttccggtttacccgggggtttacccgggttaacccgggggttaaccgggttaag

SEQ ID NO: 399204 - DNA, 544 bp, Homo sapiens
  misc_feature: GZ8MTXP01CNAXV.4.67.G01.1.454.CMB.2.raw
  modified_base (273)..(273): a, c, t, g, unknown or other
  modified_base (306)..(306): a, c, t, g, unknown or other
  modified_base (385)..(385): a, c, t, g, unknown or other
  modified_base (421)..(421): a, c, t, g, unknown or other
  modified_base (441)..(441): a, c, t, g, unknown or other
  modified_base (456)..(456): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctggtggctaattttaaaaggtgtcagtgtgaagtgcagctggtggagtcgtgggggaggccgtggcacgaggccgggggggtccctgagactctctgtgcagcctctggnttcagttagaatgtctgccatgaccgtggtccncgaggctccgtagggggaagggctggagtggatccgtgagggtattacgtggccatggcgtattaatacaatatactanagactcgtgaacgggctctcaccatcacaaggacanaacttaccaagaacagggtntatctagacaataanacacgacgagacgagacgacgacgaacgacacattagtacgtgagacgaagaagtcgtcggtcggtcggttccggtcgggttcgggtg

SEQ ID NO: 399205 - DNA, 579 bp, Homo sapiens
  misc_feature: GZ8MTXP01AFEQP.4.67.G01.1.454.CMB.2.raw
  modified_base (270)..(270): a, c, t, g, unknown or other
  modified_base (360)..(360): a, c, t, g, unknown or other
  modified_base (372)..(372): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaagtgcagctggtggagtcgtgggggagcctggcacgaggccggggggtccctgacgactctcctgtgcagcctntggattctagtttagaatgtctgccatgacctgggtcccgccgaggctccgtgggggaagggctggagtggatctgaggagttaggcgcngtgactattaanactaattaatatacacgtacgtacgtacgacggccgtctacctacctactacctacgacgaacgaactaactaaccgaaacgaacgtacgtagtacgtactacgaacaaacgtaacgaacgacgacgagagacgacgacgacgaacgacacacttagtactagagacgaagtaagtcgtcggtcggtcggttccggtcggttcggtg

SEQ ID NO: 399206 - DNA, 530 bp, Homo sapiens
  misc_feature: GZ8MTXP01DBHOS.4.67.G01.1.454.CMB.2.raw
  modified_base (302)..(302): a, c, t, g, unknown or other
  modified_base (364)..(364): a, c, t, g, unknown or other
  modified_base (412)..(412): a, c, t, g, unknown or other
  modified_base (442)..(442): a, c, t, g, unknown or other
  modified_base (454)..(454): a, c, t, g, unknown or other
  modified_base (477)..(477): a, c, t, g, unknown or other
  modified_base (482)..(482): a, c, t, g, unknown or other
  modified_base (495)..(495): a, c, t, g, unknown or other
tcagagcactgtagcacgaccggtgctcgatttagagtatacatattgggtttggggtctgagagaggagcccagccctgggattttcaggtgtttcatttggtgatcaggactgaacagagagaactcaccatggagtttgggctgagctggcttttcttgtggctattttaaaaggtgtccagtgtgaagtgcagctggtggagtcgtgggggaggcctggcacgaggccgggggggtccctgagactctcctgtgcagcctctggattcagttagaatgtctgccatgacgtgggtccncaggctccgtgggagggctggagtggatctcgagggtataggtcggcacgtggcgtattaanacaatatttagacagtacctcgagaacgggctcttcacatctacaganacataccaagacacgtgtaatctgacaatnaaccagcctagngagccgaggacaacggcacattntaacngttacgcgaaagntcgtcggtcgtcgggttccggcggttccgggtaag

SEQ ID NO: 399207 - DNA, 391 bp, Homo sapiens
  misc_feature: GZ8MTXP01A7C6D.4.67.G01.1.454.CMB.2.raw
  modified_base (385)..(391): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctggggtcagcccaaggccaaccccatgtcactctcgttcccgccccctcctctacagtcgctctgagcgggctggcaaggcgcatagnnnnnnn

SEQ ID NO: 399208 - DNA, 544 bp, Homo sapiens
  misc_feature: GZ8MTXP01EGFHU.4.67.G01.1.454.CMB.2.raw
  modified_base (307)..(307): a, c, t, g, unknown or other
  modified_base (375)..(375): a, c, t, g, unknown or other
  modified_base (391)..(391): a, c, t, g, unknown or other
  modified_base (401)..(401): a, c, t, g, unknown or other
  modified_base (485)..(485): a, c, t, g, unknown or other
  modified_base (494)..(494): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgaggccggggggtccctgagactctcctgtgcagcctctggattcagtttagaatgtctgccatgacctgggcccnccaggctccgtggggaaggggctggagtggatctcgagggattaggtcggcacgtggctattaatacntatataccagactcgngaacgggccnctcacatctccaagagacaattccaaagaacacggtatagtctgacaaatgaacagcctagagagcccgaggacaacggtccanattacttangttgcgaaagaatcgtcgggcgttcgggttccgtcgggttccggggtaag

SEQ ID NO: 399209 - DNA, 513 bp, Homo sapiens
  misc_feature: GZ8MTXP01AW2YV.4.67.G01.1.454.CMB.2.raw
  modified_base (154)..(154): a, c, t, g, unknown or other
  modified_base (183)..(183): a, c, t, g, unknown or other
  modified_base (200)..(200): a, c, t, g, unknown or other
  modified_base (206)..(206): a, c, t, g, unknown or other
  modified_base (210)..(210): a, c, t, g, unknown or other
  modified_base (214)..(214): a, c, t, g, unknown or other
  modified_base (218)..(218): a, c, t, g, unknown or other
  modified_base (249)..(249): a, c, t, g, unknown or other
  modified_base (258)..(258): a, c, t, g, unknown or other
  modified_base (260)..(260): a, c, t, g, unknown or other
  modified_base (271)..(271): a, c, t, g, unknown or other
  modified_base (275)..(275): a, c, t, g, unknown or other
  modified_base (304)..(304): a, c, t, g, unknown or other
  modified_base (306)..(306): a, c, t, g, unknown or other
  modified_base (309)..(309): a, c, t, g, unknown or other
  modified_base (336)..(336): a, c, t, g, unknown or other
  modified_base (345)..(345): a, c, t, g, unknown or other
  modified_base (352)..(352): a, c, t, g, unknown or other
  modified_base (425)..(425): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcggngtggtttctaggcggctaattttaaaggntcagtgtgaagtgcagntgtggngtgngggngcgngcgacgcggcgggtcgtgagctctctgtgcncgctctgtntntagtatatgtntgcntcgtcgtcggtcgcgcgcgtcgtggaggngnggngtgtgtgtgtagtagtgtcgcgtgtgntataatatntatatanacgtacgtacgtagacgtctctacacactcacgagacactactacgagaacgtagtagtagtacgtagacaanagacgacgacgagagacgacgacgacgaacgacactattagtagtagacgacgacgtcgtcgtcggtcgtcgttcggtcggttcggtg

SEQ ID NO: 399210 - DNA, 600 bp, Homo sapiens
  misc_feature: GZ8MTXP01EN5PS.4.67.G01.1.454.CMB.2.raw
  modified_base (268)..(268): a, c, t, g, unknown or other
  modified_base (284)..(284): a, c, t, g, unknown or other
  modified_base (290)..(290): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctaattttaaaggtgtcagtgtgaagtgcagctgggtggagtcgtgggggaggcctgggcacgaggccgggggtcctggagctctcctgtgcagccctntggattcaggtttaanatgtcngctatcgaccgtcggccgcgacggctcggaggggacgggtcgtggagtggtatcgtagaggtagttaggtcggactacgtggactattaaactaactaattaataaactacgacgtaccgtcggtaggaaccgggtcctactaccacctactacctacgaaagacaactaactaacgaaacgaacgtaacgtagtacgtactagtaactaaacgtaacgaacgacgacgtacgacgacgacggacgacgaacgacactacttagtagtgacgacgagaagtcgtcggtcgtcggttcggtcggttcggtg

SEQ ID NO: 399211 - DNA, 738 bp, Homo sapiens
  misc_feature: GZ8MTXP01AO2L8.4.67.G01.1.454.CMB.2.raw
  modified_base (308)..(308): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggagcctggcacgaggccggggggtccctgagactctcctgtgcagcctctggattcagtttagaatgtctgccatcgacctgggtcccnccaggctccgtgggggaaggggctgggagtggatcgtcgaggggattaggtcggcacgtgggacgtaatttaaataacaattattaataacgagtaccttcccggtaggaaacgggggtccctactttccaaccctatcccttacccgaaggacgaaacctaaacgtttacccaaaaggaaacccgtaaccgggggttagttaactacccgtttagggaaaccctaaaacgttagggaaaacccaacggtcccgttagggaaacggtaccgggaccccggaaagggggaacccaaccggggttaccccaaacgtaagtttaaactttaaccgtagggttacggaacccggttaaaaaaggtcgttacccggttcccgggggctttccgggggtttaccccgggtccgggggtttccccgggggttaaagg

SEQ ID NO: 399212 - DNA, 592 bp, Homo sapiens
  misc_feature: GZ8MTXP01DHKWC.4.67.G01.1.454.CMB.2.raw
  modified_base (309)..(309): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctaattttaaaaggtgtcagtgtgaagtgcagctggtggagtcgtgggggagcctggcacgaggccggggggtccctggagactctcctgtgcagcctctggattctagtttagaatgtctgccatcgacctcgggtccncgaggcctccgtggggaagggctggagtggatctcgaggggattaggcggctagtggactaattaactactaattaataactaacgagtaccgtcggtaggacggcctactaccactactccgtacaagaacaactaactaacgaaacgaaacgtaacgtacgtacgtacgtacgtaactaaacgtaacgaacgacgacgacgacgacgacgacgacgaacgacactattagtacgtgttagacgaacgtaagtcgtcggtcgtcggttcggtcggttcggtg

SEQ ID NO: 399213 - DNA, 636 bp, Homo sapiens
  misc_feature: GZ8MTXP01BDMMT.4.67.G01.1.454.CMB.2.raw
  modified_base (303)..(303): a, c, t, g, unknown or other
  modified_base (346)..(346): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctaattttaaaggtgtcagtgtgaagtgcagctggtggagtcgtgggggagcctggcacgaggccggggggtcctgagctctcctgtgcagcctgtggattctagttagatgtctgccatgaccgtgggtcccnccaggctccgtaggggaacgggtctggagtggatcgtgagggnttaggcggcagtggactattaaataacaatatttaaacacgacgtaccgtcggtaggacggtccctactaccactacgtccaacgaagaactaactaactaaccgaaagaacgtacggttatacgtacgtagaacaaacgtaacgaacgacgtacgacgacgacgaccggaaccggaaccgaaccgaaccgaacgtaacttaacgttaacgtacgttacgaacgttaaacgtaacgtaccggtccgggtccgggttaccgggttacccgggtccgggttccgggtaacgg

SEQ ID NO: 399214 - DNA, 615 bp, Homo sapiens
  misc_feature: GZ8MTXP01D0NF2.4.67.G01.1.454.CMB.2.raw
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgagggccggggggtcctgagactctcctgtgcagcctctggtattctagttagatgtctgccatcgaccgtggtcccgcaggcctccggtagggggaagggctggagtggatcgtagaggtattaggtggcacgtgggactaattaactaactaataatttaactaacacgtaccgtccggtaggaaacgggcccgtcttaccaccatcctaccaagaacgaacaactaccaaagaacgaacgtgtaactctagaaccaaagtacgaacgacgccgtaggacgacggacccggaacggaccgaaccggacccataacttattaactgttacgacgaaaagtcgtcggtccggtcgtcgggttcccggtcgggttccgggtaag

SEQ ID NO: 399215 - DNA, 651 bp, Homo sapiens
  misc_feature: GZ8MTXP01CNUSL.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccgggggggtccctgagactctcctgtgcagcctctggattcagttagaatgtctgccatcgaccgtgggtcccgcaggcctccgtggggaacgggctggagtggatcgtcgaggggtattaggtcggcacgtgggaccgtaatttaactaacgaattaatttaaactaacgtagtaccgtcccggtagggaaacggggcccgtacttaccacctatcctacccgaagaacgtaactaacgttacccaaagaaccgtacgggttgtaactcgttacggacctaaaagtcgaaaccaggccctaaggacgacggcccgaaggaccaaccggaccagtacttagttaaacctggttacgacgttaaacgaacgttccgtcggggtccgttcgggttacccgggccgggtttccggggtaag

SEQ ID NO: 399216 - DNA, 764 bp, Homo sapiens
  misc_feature: GZ8MTXP01B175J.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtcctgagactctcctgtgcagcctcgtggattctagttagaatgtctgccagtcgaccgtcgggtcccgccgacggctccgtagggggaacgggggtctgggagtggatcgtacgagggtattaggtcggctacgtggacgtaatttaaactaactaattaattaataacgacgtaccgttaccggtagggaaacggggcccgtacttaccaaccctatccctaccgaacgaacgtaacctaaacgttaccgaaaacgtaaaccgtacgggttagttaacgttccgtaaggtaacctaaaacgttacgaaaaccgtacggtacccgttaggaaacgggaaaccgggaccccggaaacggggaaacccgaaaccccggggaacccaaacggttaaactttaaacgtttacccggtaagggttaacggaaccggttaaaaaacggttcggttacccggttccggggggttcccggtttcccggggttaccccgggggtccgggggtttaaccccgggggttaagg

SEQ ID NO: 399217 - DNA, 640 bp, Homo sapiens
  misc_feature: GZ8MTXP01D0GBA.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttcttgtggctaattttaaaaggtgtccagtgtgaagtgcagcgtggtggagtcgtgggggaggcctggcacgagggccgggggggtccctggagactctcctgtgcagcctcgtggattctagtttagaatgtctgccatcgacctgggtcccgccaggcctccgtagggggaagggcgtgggagtggatccgtgagggattaggcggacgagtggactaattaaactaactaattattaactaacgacgtaccgtacgggtacgggaacggtcctactaccaacctataccacgaacgaacaactaactaaccaaagtaacgtaacggttagtacgtacgtacgaaactaaacgtaacgaacgacgacgtacgaacggaacggaccggaacggaacgaaccgaccactaacttacgttacgtagttacgacgaacgaacgtcgtcggtcggtcgggttccggtccgggttcgggtaacg

SEQ ID NO: 399218 - DNA, 576 bp, Homo sapiens
  misc_feature: GZ8MTXP01DHB9X.4.67.G01.1.454.CMB.2.raw
  modified_base (493)..(493): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggccgtggcacgaggccgggggggtccctgagactctcctgtgcagcctctggtattcagtttagaatgtctgccatcgaccgtggtcccgcaggctccgtaggggaaggggctgggagtggatcgtcgagggtattaggtcggcgacgtgggacgtattaaagtactaattaattatacaagtacctccggtaggaacgggccgtcttacaccatctccaagacgaactaactaccaaagtaacacgggtatatctagacaaaagtcgaaacngcctagagagccgaggccaacggccatacttattacgtgagacgaaagctcgtcgggctcgggttccgtcgggttcgggtaag

SEQ ID NO: 399219 - DNA, 627 bp, Homo sapiens
  misc_feature: GZ8MTXP01CNIMY.4.67.G01.1.454.CMB.2.raw
  modified_base (405)..(405): a, c, t, g, unknown or other
  modified_base (553)..(553): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggagcctggcacgacgggccggggggtccctgagactctcctgtgcagcctcgtggattctagtttagaattgtctgccatcgaccgtgggcccgccgaggtcctccggtagggggaagggggtctgggagtggatcgtcgagggtattaggtcggctacgtggacgtattaaatacaattattaanacagactcgtagacgggcctctcacatcctaccgagacacaactaccaaagaactgggtactatctagacaaagtcgaaacgacgtcctaggacgtacggaccggaacggtacccgaaccggacccaaagtacttaacgtttaaccgnggttacggaaccgaaagtcgtacccggttcggggtcgttacggggttccccggtcggggttaacccgggttaag

SEQ ID NO: 399220 - DNA, 633 bp, Homo sapiens
  misc_feature: GZ8MTXP01BTM73.4.67.G01.1.454.CMB.2.raw
  modified_base (303)..(303): a, c, t, g, unknown or other
  modified_base (489)..(489): a, c, t, g, unknown or other
  modified_base (518)..(518): a, c, t, g, unknown or other
  modified_base (576)..(576): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttctgtggctattttaaaaggtgtccagtgtgaagtgcagctggtggagtcgtgggggaggcctggcacgaggccgggggggtccctgagactctcctgtgcagctctggattcagttagaatgtctgcatcgacctgggtccncgaggtctccggtagggggaagggcgtgggacgtggatcgtacgagggtattaggtcggactacgtgggcgtaattaaataactaattattaactacacgtaccttccgggtaggaaacggggccctacttaccaactactccgtaccgaaggtacaactaacttaccgaaagaacctacgggttntactccgttagaactaaacgtacgaaacncgacccgtaggacgtacgggaccgacgggaaccaaccgggtacaacgtattagtacgngttacgacgaagaacgttccggcgggtcgttcggggttcccgtcggggttaacggtg

SEQ ID NO: 399221 - DNA, 598 bp, Homo sapiens
  misc_feature: GZ8MTXP01D2U6E.4.67.G01.1.454.CMB.2.raw
  modified_base (179)..(179): a, c, t, g, unknown or other
  modified_base (225)..(225): a, c, t, g, unknown or other
  modified_base (239)..(239): a, c, t, g, unknown or other
tcagagcactgtagcacgaccggtgctcgatttagagtatacatattgggtttgggtctgagagaggagcccagccctgggattttcaggtgttttcatttggtgatcaggactgaacagagagaactcaccatggagtttgggctgagcgtgtcgtttctagtggctattttaaaggngtcagtgtgaagtgcagctggtgagtgtggggaggcctggcaacgngccggggggtcccngagactctcgtgcgcacgctcgtgtatgtagttagtatgtctcgctacgtcgtcgtcggtccgcgcgcgtcggtacggaggcgtggagtggtagtcgtacgaggtagtagtcgcgtacgtgacgtagtaaactactaattattaacgtaacgtaacgtacgtacggtacggtacggtaccgtcctactactactactacgaacgaacgtaactaacgtaaccgtaaacgtaaacgtaacgtacgtaacgtacgtacgtaacaaagtaacgaacgacgacgagacgtagacgacgacgaacgacactattagtacgtgcgagagtaagtcgtcggtcgtcggttcggtcggttcggtaag

SEQ ID NO: 399222 - DNA, 687 bp, Homo sapiens
  misc_feature: GZ8MTXP01ET2D3.4.67.G01.1.454.CMB.2.raw
  modified_base (283)..(283): a, c, t, g, unknown or other
  modified_base (310)..(310): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggaggcctggcacgaggccggggggtccctgagactctcctgtgcagcctctggattctagtttanaatgtctgccatcgaccgtgggtcccnccgaggcctccgtgggggaacgggggctgggagtggactcgtacgaggggtattaggtcggctacgtggcgtaattaactactaattattaactacgacgtaccgttccggtaggaaacgggtcccgtacttaccaacctatccctaccaaacggacgtaactaaacttaccgaaacgtaacacgggttgtaacttcgtaggaacctaaaagtcgaaaccacggtaccctaaggacggtaacggacccggaacgggaacccaaccggggaacccaactaattaaacgttaccgtagggttacggacggttaaaacggtgtcccggtaaccgggggtcgttcgggggttccccggtcgggggttaacccgggttaagg

SEQ ID NO: 399223 - DNA, 406 bp, Homo sapiens
  misc_feature: GZ8MTXP01BEY33.4.67.G01.1.454.CMB.2.raw
  modified_base (358)..(358): a, c, t, g, unknown or other
  modified_base (396)..(406): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctccttgcaggcgcctctgtctcaggcagctatgtcttcggaactgggaccgaagtcgaccgtcgtgggtcagccccaaggcccaaccccatcgtccactcctcgttccccgccccctcctctacngtcgcctctggacgccgggctgggcaaggcgacatagnnnnnnnnnnn

SEQ ID NO: 399224 - DNA, 732 bp, Homo sapiens
  misc_feature: GZ8MTXP01A51E4.4.67.G01.1.454.CMB.2.raw
  modified_base (385)..(385): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttctgtggctattttaaaaggtgtccagtgtgaagtgcagctggtggagtcgtgggggaggcctggcacgaggccggggggtccctgagactctcctgtgcagcctctggattcagtttagaatgtctgccatcgaccgtgggtcccgccaggcctccgtagggggaaggggtctgggagtggatcgtcgaggggtattaggtcggctacgtgggacgtaattaanacgtaattattaactacgagtaacctccgggtaggaaacggggcccgtacttaccaaccattccgtacccgaaaggaacgtaacctaaacgtttaccccgaaaagtaaaccgtaaccgggttagttaacttacgttacggaaacctaaaagttacgaaaacccgtgtaccccgttaagggaacggtaaccggacccggaacggggaaccccgaaaccggggaaccccaaaggtaaactttaacgttaaacccgtgggttaacccgaggaaaaaccggttgttcccggtaaccgggggttccttcgggggttaccccgggtaaccgggggtttcccgggggttaaagg

SEQ ID NO: 399225 - DNA, 646 bp, Homo sapiens
  misc_feature: GZ8MTXP01DSCMF.4.67.G01.1.454.CMB.2.raw
  modified_base (268)..(268): a, c, t, g, unknown or other
  modified_base (282)..(282): a, c, t, g, unknown or other
  modified_base (297)..(297): a, c, t, g, unknown or other
  modified_base (375)..(375): a, c, t, g, unknown or other
tcagagcactgtagcacgaccggtgctcgatttagagtatacatattgggtttggggtctgagagaggagcccagccctggggattttcaggtgttttcatttggtgatcaggactgaacagagagaactcacatggagtttgggctgagcgtggcttttctagtggctattttaaaaggtgtcagtgtgaagtgcagctggtggagtcgtgggaggcctggcacgaggccggggggtcctgagctctctgtgcagcctctggacttnagtttagatgtctncatgacctggtaccnccgaggcgtccgtgggaaggggctggagtggtactcgttacgaggggatttacggtggctacgttaggcgtattaaanaactaatttatatacacgtaacgtccggtcgaaacgggtccactttacaccattaccaccaaggactaacaattacccaaagtaacacgggttattagtccttaaggaccaaaagtacggaaacaacgaccgtacggagacggaccggacggaaccgaacggtaacccgaaccgtaacgttaacttacgttaacgttaggttacgaacggtaacgtaccgtccggggtcggttcgggttaccgggtcccgggttaacccgggttaacgggg

SEQ ID NO: 399226 - DNA, 689 bp, Homo sapiens
  misc_feature: GZ8MTXP01DJW2Y.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttctgtggctattttaaaaggtgtccagtgtgaagtgcagctggtggagtcgtgggggaggcctggcacaggccgggggtcctgagactctcctgtgcagcctctggtattactagtttagaatgtctgccatgaccgtgggtccgccgaggctccgtgggggaaggggcgtggaggtggatcgtcgaggggattaggtcggtcacgtggtaccgaattaactaactaattaattaataacacgtaccgttacggtacggaacgggtcccgtctttacaacccaacttccttacccaaagacgtaaactaacttaccaaacgtaaacaccggggttagtaacgttaccttaggaaccaaaagttacggaaaccacggttcccgtaaggaggtaacgaccccgggaaggacccggaaaccgggccaaccgtaaattaaccgttaaacgttggttacgacccggaaaaacggtgttacccggtccgggggtcgttccgggttacccggttccgggggttcccggggtttaaggg

SEQ ID NO: 399227 - DNA, 661 bp, Homo sapiens
  misc_feature: GZ8MTXP01AR19M.4.67.G01.1.454.CMB.2.raw
  modified_base (281)..(281): a, c, t, g, unknown or other
  modified_base (305)..(305): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctattttaaaggtgtcagtgtgaagtgcagctggtggagtcgtgggggagcctggcacgaggccggggggtccctggagactctcctgtgcagcctctggtattcagtttanaatgtctgccatgacctgggtccncgaggctccgtgggggaacgggctggacgtggatcgtgagggtattagcggcacgtggcgatttaatataattatttacaacgtacgtacttcccgggtagggaaacggggtcccctctttaccaacccctattccccctaacgagggaaacgtaacctaaacgttacccaaaacgaaacccgaggggtttactaagtccttaacggaaactaaacgtaacgaacgacgtaccgtacgacggacggaccggaccggaccgaaccgaccgactacttacgttacgtacgttacgttacgaacgtaacgtaccggtccgggtccggttcgggttccgggtccgggttccgggtaacgg

SEQ ID NO: 399228 - DNA, 713 bp, Homo sapiens
  misc_feature: GZ8MTXP01B276K.4.67.G01.1.454.CMB.2.raw
  modified_base (384)..(384): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagcgtggtggagtcgtgggggaggcctggcacgagggccgggggggtccctgagactctcctgtgcagcctctggtattctagttagaatgtctgccatcgaccgtcgggtcccgcaggctccgtgggggaagggcgtggagtggatcgtcgagggtattaggtcggctacgtggacgtattaaanactaattaattatacgagtaccgtccgggtaggaaaccggggtccctacttaccaaccactcctacccgaaggaacgtaacctaaacttaccccgaaaagtaaaccgtacgggttagtaacttccgttaaggaactaaaacgtcggaaaccgacggtacccgtaaggaacgtaaccgggacccggaaacgggaaccccgaaccgggttaccccaaagttaaccttaagtttaacccgtgggttacccggaaggttaaaacggtcgttcccggtcgggggtccggttacgggggttccccgggtaaccgggggttcccggggtttaaggg

SEQ ID NO: 399229 - DNA, 774 bp, Homo sapiens
  misc_feature: GZ8MTXP01DYCOC.4.67.G01.1.454.CMB.2.raw
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagctggtctttttcttgtggtcttaattttaaaaggtgtccagtgtgaagtgcagctggtggagtcgtgggggaggcctggcacgagggccggggggtccctggacgactctccgtgtgcagcctcgtggtattctagtttagaatgtctgcctatcgaccgtgggtcccgccgaggcctccggtagggggaacggggtcgtaggggacgttggacgttcgtacggaggggtattaaggtcggctacgtgggactaattaaataactaataattaataccagtaccgtcccgggtagggaaccgggtccgtcttaccacctactccgtaccgaaggaactaaacctaaacgttaacccaaaaggtaaaccgtacgggttacgttaacggttaccgtacggtaaaccaaaacgttaacgaaaaccgtaccggaccgttaacgggaacggtaaacccgggcccgggaaaacggacccggaaacccgggacccaaacgttaaccttaaagtttaaccgttacgggttaacgttaacccggaaaaaggttaaccgttcccgggttccggggttccgggttccgggggtttaccccggggtaaccgggggtttcccgggggtttaaaggg

SEQ ID NO: 399230 - DNA, 398 bp, Homo sapiens
  misc_feature: GZ8MTXP01BP81D.4.67.G01.1.454.CMB.2.raw
  modified_base (249)..(249): a, c, t, g, unknown or other
  modified_base (361)..(361): a, c, t, g, unknown or other
  modified_base (390)..(398): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctccttgcaggcgcctntgtctcaggcagctatgtcttcggactgggaccgagtcgaccgtctgggtcacgcccaacggcccaaccccactcgtccacttcctcgttccccaccccctcctctacagtnaactctgagcgggctggcaggcacatagnnnnnnnnn

SEQ ID NO: 399231 - DNA, 621 bp, Homo sapiens
  misc_feature: GZ8MTXP01CGBAW.4.67.G01.1.454.CMB.2.raw
  modified_base (179)..(179): a, c, t, g, unknown or other
  modified_base (224)..(224): a, c, t, g, unknown or other
  modified_base (252)..(252): a, c, t, g, unknown or other
  modified_base (255)..(255): a, c, t, g, unknown or other
  modified_base (274)..(274): a, c, t, g, unknown or other
  modified_base (325)..(325): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctagtggctatttaaaggngtcagtgtgaagtgcagctggtgagtcgtggggagcctggcacgnggccggggggtccctgagactctcctgngcncgctgtagtattctagtanatgtctgctagtcgtcgtcggccgcgacgtcgtcggagggaggtcgtaggnggtggtacgtacgtacgtaggtagtaggtccggtacgtacgtacgtacgtaagttaaacttaactaataagtaacgtaacgtacgtacgtacggtacgggtacggtccgtaccgtacctactactacctacgaacgtaactaactaactaacgtaaacgtaacgtacgtacgttacgtacgtacgtaacgtaacgtaacgaacgacgacgagacgacgacggacgacgaacgacactacgttacgtacgtgttacgacgacgtaagtcgtcggtcgtcggttcggtcggttcggtg

SEQ ID NO: 399232 - DNA, 671 bp, Homo sapiens
  misc_feature: GZ8MTXP01EX06U.4.67.G01.1.454.CMB.2.raw
  modified_base (289)..(289): a, c, t, g, unknown or other
  modified_base (315)..(315): a, c, t, g, unknown or other
tcagagcactgtagcacgaccggtgctcgatttagagtatacatattgggtttggggtctgagagaggagcccagccctgggatttttcaggttgttttcatttggtgatcaggactgaacagagagaactcaccatggagtttgggctgagcttggtctttttcttgtggtcttaattttaaaaggtgtccagtgtgaagtgcagctggtggagtcgtgggggagcctggcacgaggccggggggtccctgacgactctcctgtcgcagcctcgtggattctagttanatgtctgcagtcgaccgtcgggcccncgaggctccggtgggggaacgggtcgtggagttggactcgtacggaggggtatttacggcggacctagtgggacgttaattaaactaacgtaatttaatttaactaacgacgtaccgttccgggtagggaaccggcccgtcttaccaacctactcctaccaagaacgaactaaacttaccgaaacgtaacgtacgggtacttaacgtcgttaaggaaacctaaagtacgaaacgcgtaccgtaggaacggaccggacccggaacggaaccgaaccggaccttaacgtaacttacgtacgtgttacgacgaagtcgtcggtcgggtcgtcgggttaccggtcgggttaaccggtaag

SEQ ID NO: 399233 - DNA, 611 bp, Homo sapiens
  misc_feature: GZ8MTXP01AWUDG.4.67.G01.1.454.CMB.2.raw
  modified_base (257)..(257): a, c, t, g, unknown or other
  modified_base (261)..(261): a, c, t, g, unknown or other
  modified_base (265)..(265): a, c, t, g, unknown or other
  modified_base (267)..(267): a, c, t, g, unknown or other
  modified_base (273)..(273): a, c, t, g, unknown or other
  modified_base (278)..(278): a, c, t, g, unknown or other
  modified_base (280)..(280): a, c, t, g, unknown or other
  modified_base (282)..(282): a, c, t, g, unknown or other
  modified_base (317)..(317): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctagtggctaatttaaaggtgtcagtgtgaagtgcagctggtggagtctgggggagcctggcacgaggtccggggggtccctgagctctcctgtgcngctntgtntntagtanatgtntncntcgtcgtcggtccgccgcgcgtcggtagggagggnggtggtagtggtacgtcgtacgtaggtagtaggtcggcgtacgtacggtacgtattaaactaactaataataactacgtacgtacgtacgtacggacggtaccgtacctacctactactacctacaacgaacgtaactaactaaccgaacgtaacgtacgtacgtacgtacgtacgaacgaaacgtaacgaacgacgacgtacgacgacgaccgacgaccgaaccgaccactattagtacgtagacgacgaacgtaacgtcgtcggtcggtcggttccggtcgggttcggtaag

SEQ ID NO: 399234 - DNA, 712 bp, Homo sapiens
  misc_feature: GZ8MTXP01EVTGE.4.67.G01.1.454.CMB.2.raw
  modified_base (230)..(230): a, c, t, g, unknown or other
  modified_base (266)..(266): a, c, t, g, unknown or other
  modified_base (371)..(371): a, c, t, g, unknown or other
  modified_base (376)..(376): a, c, t, g, unknown or other
  modified_base (384)..(384): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcttttctaggtggctattttaaaaggtgtccagtgtgaagtgcagctggtggagtcgtgggggagcctggcacgnggccggggggtccctgacgctctcctgtgcagcctntggattctagttagatgtctgcatcgaccgtcggtcccgccgaggtccgtccggtagggggaagggggtctgggagtggactgtcgagggtatggtcggctacgngagtnttaaatanaattaattaactacgagtaccgttaccggtaggaaacggggtcctcttaccacctacttcctaccgaaagaacgttaaccaaacgtttaccaaaacgtaaacgtaccgggttagtaaagttcccttaaggaaaacgtaaacgtaaacgaacgtaaccgtaccgtaacggaacggtaaccggaccgggaaccggaaccggaaccggaacccgaaaccgtaaacgttaacgttaacgtaacggttaacggttaacggttaaacggtaacggttaccggttaaccgggttccgggttcgggttaccgggtccggggttaacgggttaacgg

SEQ ID NO: 399235 - DNA, 743 bp, Homo sapiens
  misc_feature: GZ8MTXP01D36ZI.4.67.G01.1.454.CMB.2.raw
  modified_base (290)..(290): a, c, t, g, unknown or other
tcagagcactgtagcacgaccggtgctcgatttagagtatacatattgggtttggggtctgagagaggagcccagccctgggatttttcaggttgttttcatttggtgatcaggactgaacagagagaactcaccatggagttgggctgagctggtctttttcttgtggctaattttaaaggtgtccagtgtgaagtgcagcgtggtggagtcgtgggggagcctggcacgacgggccggggggtccctggagtacctctcctgtcgcagcctctggtattctagtttanatcgtctgccatcgaccgtcgggtccccgccgacggtccttccggaggggggaacggggtcgtagggggtaggttgggtaacttccgtacggaagggggtactttagggcggaccgtacggtggacgtaaatttaaactaactaatttaacttaacgtaaaccgaacgtaccgtacgggttacgggaaacgggtcccgttcttaccgaacctacttaccacccgaaaggtacgaaacctaaacgttaccgaaaacgtaaccgtaacggttacgttacttaacgtaggaaacctaaaaggtacaaaccgagtcccgtaaggacggaacggaccggtaacgggaacccaaccggtaccttactaaatttaacgttaacgttgacggaacgaaaacgtcgttaccgggtcggggtccggttaccgggtttccggggccgggttaaccgggttaagg

SEQ ID NO: 399236 - DNA, 641 bp, Homo sapiens
  misc_feature: GZ8MTXP01ATM9E.4.67.G01.1.454.CMB.2.raw
  modified_base (316)..(316): a, c, t, g, unknown or other
  modified_base (586)..(586): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggccgtggcacgacgggccgggggggtccctggagactctcctgtgcagcctctggattctagtttagaatgtctgccatcgaccgtgggtcccncgaggctccggtgggggaaggggctgggagtggatcgtcgagggtattaggtcggcacgtgggacgtattaaatactaattaattaactacacggtaccgtccggtaggaaacggggtccctcttaccaacctattcctaccgaacggacaaacctaacttacccaaaagaacgtaccgggttagtaactccgtaggaacctaaagtgaaaccacgcctaggacggacggacccggaaggaacccgtaacggcccaatacttagttacgngttacgacgaaagtcgtcgtcgggcgttcggggttcccgtcgggttccgggtaag

SEQ ID NO: 399237 - DNA, 777 bp, Homo sapiens
  misc_feature: GZ8MTXP01DHBSB.4.67.G01.1.454.CMB.2.raw
  modified_base (314)..(314): a, c, t, g, unknown or other
  modified_base (327)..(327): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggtctaattttaaaaggtgtccagtgtgaagtgcagctggtggagtcgtgggggaggccgtggcacgacggccgggggtccctgagactctcctgtgcagcctctggtattctagtttagaatgtctgccatcgaccgtcgggtcccnccgaggcctccgngggggaagggctggagtggactcgtcgagggtattaggtcggctacgtgggtacgtaatttaaactaactaattaaactttaacgtaaaccgaaggtacccgttccggggttaacggggtaaacccgggggtcccttcctttaccaaccctaacttccgttaacccgaaaggaacgtaaacctaaaaccgttacccgaaaacgtaaacccgtacggggtttaacgttaacgtttaccgtaacggtaaaacctaaaacggtacggaaaacccacgggacccgttaaggaacgggtaccggacccggaaacgggaacccgaacccgggaacccttaaactaaacgttaacgtttaaccggtaggttacccggttaaagaaaacgtcgtaaccggttcccggggtcgtttaccgggggttacccgggtccgggggttaacccgggtttaaggg

SEQ ID NO: 399238 - DNA, 927 bp, Homo sapiens
  misc_feature: GZ8MTXP01BCZX9.4.67.G01.1.454.CMB.2.raw
  modified_base (311)..(311): a, c, t, g, unknown or other
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagcgttggtctttttcgttgtggtacttaatttttaaaaggtgtccagtgtagaagtgcagcgtggtggagtcggtggggggacgccgtggccgaccggagggcccgggggggtccctgacgtacctcgtcctgtcgcacgcctcgtggtattctagtttanatgtctagccagtcgaccgttcgggtacccgccgacggtccgtaccggtagggggaaagggggtccgttgggggaacggttgggtaacttccgtaacgggtaaggggttacgtttaaggggttcccggaccgtaacggttggggtaacccgtaaagttttaaaaactaaccgttaagtttaaagttttaaactaaacccggaaggttaaaccccgttccggggttaacggggaaaacccgggggtcccccgtttacccgtttaaccccgaaaccccgttactttaccccgtaacccgtaaaagggaaacctaaacccttaaaaaccgttacccggaaaaaacggtaaacccgtaggggtttaccttaacgggttacgttaaaccggtaaaacgtaaaacggtaacgaaacccggtaccggtacccgttaaagggaaccggtaaccgggacccgggaaaccggaaaccccgtaaccccggaaaccttaaacgttaaacgttacgttaaaccggtacggttaacggaaacgggttaaaaccgttccggttccgggttcccggggttaccgggtttcccgggggttaccccggggttccggggtttaacggggtaacgg

SEQ ID NO: 399239 - DNA, 789 bp, Homo sapiens
  misc_feature: GZ8MTXP01AWAKK.4.67.G01.1.454.CMB.2.raw
  modified_base (709)..(709): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggagcctggcacgaggccggggggtccctgagctctcctgtgcagcctcgtggattcgtagttggaatgtctcgctagtcgaccgtcgggtcccgccgaggccgtaccggtgggggaacgggggtcgtgggacggtgggtacttcgtacgaaggggtagtttaggtccggacctaggtggaccgtaatttaaaacgactaatttaattaaacgtaacgtaaccggtaccgttacccgggtaggggtaaacccggggccccgttacgtttacccaaccctaacttcccgtacccgaaaaggtaacccgtaaacttaaaccgttacccgaaaaaggaaacccgttaaacggggttcttaaaacggggttccccttaaaggaaccctaaaaagttccgggaaaacacgtacccggtaaggaaccggaccggggacccgttaaacgggggaacccctaaccgggaaaccccttaggtaaattaacgtttaaccgngttaaccgggagttaaaacgtgttccggaaccggggttccgttcggggttacccgggtccgggttaaccgggtttaaggg

SEQ ID NO: 399240 - DNA, 599 bp, Homo sapiens
  misc_feature: GZ8MTXP01A78I8.4.67.G01.1.454.CMB.2.raw
  modified_base (280)..(280): a, c, t, g, unknown or other
  modified_base (304)..(304): a, c, t, g, unknown or other
  modified_base (376)..(376): a, c, t, g, unknown or other
  modified_base (411)..(411): a, c, t, g, unknown or other
  modified_base (421)..(421): a, c, t, g, unknown or other
  modified_base (484)..(484): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtcgtgggggaggcctggcacgaggccgggggggtccctggagactctcctgtgcagcctctggattcagttanaatgtctgccatgacctgggtccnccaggctccgtgggaaggggctggagtggatcgtcgaggggtattaggtcggcactgggccgtattaatacnttattataccagtacctccgtaggaacgggtcccnttacaacccntccacgaagacaactaactaccgaaagtaacgacgtatacgtactagaacaaacgtagaaccngaccgtaggaacgtacgaccgacggaccgaaccggtccaactacgttacgtacgtggttacggacgaaagcgtcggtcgggtcgttcggggttaccggcggggttaacgggtaag

SEQ ID NO: 399241 - DNA, 722 bp, Homo sapiens
  misc_feature: GZ8MTXP01CI32P.4.67.G01.1.454.CMB.2.raw
  modified_base (501)..(501): a, c, t, g, unknown or other
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagctggtctttttcttgtggcttaattttaaaaggtgtccagtgtgaagtgcagctggtggagtcgtgggggagcctggcacgagggccgggggggtccctggagactctcctgtgcagcctctggattctagttagaatgtctgccatgaccgtgggtccccgccaggtcctccggtagggggaagggggtctgggggaggtggacttcgtacgtaaggggtatttacgggtccggctacggtggacgtattaaataactaataattaaactacgacgacctccggtaggaaacgggccctacttacacctactctaccaaggtacaaactaacttaccgaaagtaaccgngttacgtattaccgtaggaaactaaagtaacgaaaccgtaccggtactacgggaacggacgggacccggttaaacggacccgtaacccgggaacccttaacgtaaaacgtttattaaaccgttcgggttaagttaaacccggaaaagttcggtacccgggttccgggggtacccgtttcggggggttccccggttaaccgggggttaaccgggtttaaggg

SEQ ID NO: 399242 - DNA, 837 bp, Homo sapiens
  misc_feature: GZ8MTXP01DK1DN.4.67.G01.1.454.CMB.2.raw
  modified_base (261)..(261): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttctgtggcttaattttaaaaggtgtccagtgtgaagtgcagctgggtggagtcgtgggggagcctggcacgaggccggggggtcctgacgctctcctgtncagcctcgtggtattctagtttagaatgtctgcctagtcgaccgtcgggtccccgccgacggtctccgggtagggggaacggggcgtggggtaggttgggacttccgtaggtaaggggtatttaacgggtcggcgtaacggtggggtaaccttaatttaaaactaactaatttaagtttaaactaaaccgtaacgtaccccgttacccgggtagggaaaccggggtccctacctttacccaaccgtaacttccccttaacgaaacgggaacgtaaaccctaaaaccgtttaacccgaaaaacgtaaaccgttaacggggttaaccgtttaagttaaccccggttaaacgtaaaacccgtaaaggtaaccgaaaacccggtacgtaccggtaaacggaaacggtaccgggaaccccgggaaccggaaacccggaaacccggttaacccgttaaacgttaaacgtttaaacgttacggtacggttaaacgggaaacggttaaaacggtccggtttcccggtaaccggggtttccgggttccggggtttaccccgggtcggggttaaccggggttaacg

SEQ ID NO: 399243 - DNA, 596 bp, Homo sapiens
  misc_feature: GZ8MTXP01BZJRW.4.67.G01.1.454.CMB.2.raw
  modified_base (393)..(393): a, c, t, g, unknown or other
  modified_base (396)..(396): a, c, t, g, unknown or other
  modified_base (427)..(427): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctaggtggctaattttaaaaggtgtccagtgtgaagtgcagctggtggagtcgtgggggaggcctggcacgagggccgggggggtccctggagactctcctgtgcacgctctggattcagttagaatgtctgccatcgaccgtcgggtccccgccgacggtcctccggtagggggaacggggtcgtggggagttgggatcgtcgagggattggtggcacgtggactattaanacnttattatacagtactccgtagacgggtcccncttaccacctatcctaccgaagaacgaactaaactaccgaaagaacgtacgggtatacgtctaggaacaaactagaacgacgaccgacgagacgaccgacggacgaacggacaccattatactgttgcgaagaatcgtcggtcgtcggttccggtcggttccggtaagg

SEQ ID NO: 399244 - DNA, 554 bp, Homo sapiens
  misc_feature: GZ8MTXP01DL79E.4.67.G01.1.454.CMB.2.raw
  modified_base (155)..(155): a, c, t, g, unknown or other
  modified_base (182)..(182): a, c, t, g, unknown or other
  modified_base (283)..(283): a, c, t, g, unknown or other
  modified_base (293)..(293): a, c, t, g, unknown or other
  modified_base (299)..(299): a, c, t, g, unknown or other
  modified_base (304)..(304): a, c, t, g, unknown or other
  modified_base (326)..(326): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgngttttctaggtggctattttaaaaggngtcagtgtgaagtgcagctgggtggagtcgtgggggagcctggcacgaggccggggggtcctgagctctctgtgcagcctctggattcagttagaatcgtntgcatgaccnggtccncagcncgtagggagggctggagttggntcgagaggtatagcgctagtgactaataaatataatataacacgagtacgtcgtagacggtcctctacacactccgacaagacaactaactaacgaacgaacgacgtagtacgtactacgaacaaactaagaacgacgacgacgacgacgacgacgacgaacgacactacttacgtacgtagacgacgaagtaacgtcgtcgtcgtcggttcggtcggttcggtaacg

SEQ ID NO: 399245 - DNA, 576 bp, Homo sapiens
  misc_feature: GZ8MTXP01AS49O.4.67.G01.1.454.CMB.2.raw
  modified_base (313)..(313): a, c, t, g, unknown or other
  modified_base (380)..(380): a, c, t, g, unknown or other
  modified_base (406)..(406): a, c, t, g, unknown or other
  modified_base (413)..(413): a, c, t, g, unknown or other
  modified_base (416)..(416): a, c, t, g, unknown or other
  modified_base (421)..(421): a, c, t, g, unknown or other
  modified_base (440)..(440): a, c, t, g, unknown or other
  modified_base (459)..(459): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgacgggccgggggggtccctgagactctcctgtgcagcctctggattctagtttagaatgtctgccatcgacctgggtcccnccgaggctccgtgggaaggggctggagtggatctcgagggattaggcggcacgtggctattaatacnttatatacagactccgagacgggccncttcacntcncaganacaactacaagaacaggtnatctagacaaatgaaacgngtccgagaacgacgaccgaggaccaacggtaccaactaattacgttaccgtgttacgaacgaaagtaacgtccggtccgggtcgtaccggggttcccggcgggttaacccgggtaag

SEQ ID NO: 399246 - DNA, 522 bp, Homo sapiens
  misc_feature: GZ8MTXP02I0Y19.4.67.G01.1.454.CMB.2.raw
  modified_base (257)..(257): a, c, t, g, unknown or other
  modified_base (265)..(265): a, c, t, g, unknown or other
  modified_base (267)..(267): a, c, t, g, unknown or other
  modified_base (278)..(278): a, c, t, g, unknown or other
  modified_base (280)..(280): a, c, t, g, unknown or other
  modified_base (314)..(314): a, c, t, g, unknown or other
  modified_base (316)..(316): a, c, t, g, unknown or other
  modified_base (319)..(319): a, c, t, g, unknown or other
  modified_base (323)..(323): a, c, t, g, unknown or other
  modified_base (348)..(348): a, c, t, g, unknown or other
  modified_base (357)..(357): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgtttctagtggctatttaaaaggtgtccagtgtgaagtgcagctggtggagtctgggggaggcctggcacagccgggggggtccctgagactctcctgtgcngctctgtntntagttagtatntntgcatcgcgtcggtccgcgcgcgtcgtggagggngnggngtgntctcgaggtagtagtcgcgacgtgngtatatatntattatacagactcgtagacggcgtctcacactctcagacaactaactaacaacgaacgacgtagtatactagacaatagaacgacgacgagagagacgacgacgacgacacactatactacgtacgacgaagaagtcgtcggtcgtcggtcggtcggtcggtcg

SEQ ID NO: 399247 - DNA, 584 bp, Homo sapiens
  misc_feature: GZ8MTXP02JNNDE.4.67.G01.1.454.CMB.2.raw
tcagagcactgtagcacgaccggtgctcgatttagagtatacatattgggtttgggtctgagagaggagcccagccctgggattttcaggtgttttcatttggtgatcaggactgaacagagagaactcaccatggagtttgggctgagcgtggcgttttctagtggctattttaaaggtgtccagtgtgaagtgcagctggtggagtctgggggaggcctggcacagccggggggtcctgagactctcctgtgcagcctctggattcagttttagaatgtctgccatgacctgggtccgccaggctcctgggaaggggctggagtggatctcaggggatttaggcggcacgtggacgtattatactattaattactaacgagtacctcggtaggaacgggtcccgtcttaccaccctatccgtaccgaagacgaactaaacttaccaaagaaccgtacggtgtaatcgtagacaatagaacgacgacgtacgacgacgacgacgacgaccggaccgacactaacttacgtacgtacgacgaacgaacgtacgtacggtcgtcggtccggtccggtacggtacg

SEQ ID NO: 399248 - DNA, 507 bp, Homo sapiens
  misc_feature: GZ8MTXP02FWU2V.4.67.G01.1.454.CMB.2.raw
  modified_base (349)..(349): a, c, t, g, unknown or other
  modified_base (357)..(357): a, c, t, g, unknown or other
  modified_base (382)..(382): a, c, t, g, unknown or other
  modified_base (389)..(389): a, c, t, g, unknown or other
  modified_base (414)..(414): a, c, t, g, unknown or other
  modified_base (416)..(416): a, c, t, g, unknown or other
  modified_base (419)..(419): a, c, t, g, unknown or other
  modified_base (421)..(421): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctatttaaaaggtgtcagtgtgaagtgcagctggtggagtctgggggaggcctggcacaggccggggggtccctgagactctcctgtgcagctctggatcagtttagaatgtctgccatgactggtcgcagctcctggagggcgtggagtggagtctcaggagtagtgcactgcgatatantatataanagactacgtagacggcgctcacacnctcaganacactacacacgagtagtatactananaananacacgacgacgacggacgacgacgacgacacatactactacgtacgacgaagagtcgtcggtcgtcggtcggtcggtcggtacgtg

SEQ ID NO: 399249 - DNA, 540 bp, Homo sapiens
  misc_feature: GZ8MTXP02FXNHT.4.67.G01.1.454.CMB.2.raw
  modified_base (368)..(368): a, c, t, g, unknown or other
  modified_base (370)..(370): a, c, t, g, unknown or other
  modified_base (397)..(397): a, c, t, g, unknown or other
  modified_base (443)..(443): a, c, t, g, unknown or other
  modified_base (445)..(445): a, c, t, g, unknown or other
  modified_base (448)..(448): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctagtggctatttaaaaggtgtcagtgtgaagtgcagctggtggagtctgggggaggcctggcacgaggccgggggggtccctggagactctcctgtgcagcctctggattctagtttagaatgtctgccatgacctgggtccgccaggctccgtggggaaggggctggagtggatctgagggattaggtggcacgtggcgtattananatattatacagactcgtgaacgggccncttcacctatcctccagacacaataccaagaacacgtagtatctananaanagaacgacgacgagagacgacgacgacgacgacacactatactacgtacgacgaagaacgtcgtcggtcggtcggtcggtcggtacggtacg

SEQ ID NO: 399250 - DNA, 533 bp, Homo sapiens
  misc_feature: GZ8MTXP02JPXWD.4.67.G01.1.454.CMB.2.raw
  modified_base (365)..(365): a, c, t, g, unknown or other
  modified_base (376)..(376): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgttttctaggtggctattttaaaaggtgtccagtgtgaagtgcagctggtggagtctgggggagcctggcacagccggggggtccctgagactctcctgtgcagctctggattcagtttagtaatgtctgccatgacctgggtccgccaggcgtccctggaaggggcgtggagtggagtctcaggagttagtggcgactggcgattatanatatattacanactcgtgaagggccggcttcaccatctcccagagacaattaccagaaacacggtagtaatctagacaatagaacgacgacagagacgacgacgacgacgacacactatactacgacgacgaagaacgtcgtcggtcgtcggtccggtcggtcggtcg

SEQ ID NO: 399251 - DNA, 547 bp, Homo sapiens
  misc_feature: GZ8MTXP02HLMN2.4.67.G01.1.454.CMB.2.raw
  modified_base (374)..(374): a, c, t, g, unknown or other
  modified_base (380)..(380): a, c, t, g, unknown or other
  modified_base (418)..(418): a, c, t, g, unknown or other
  modified_base (502)..(502): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctgggtggagtctgggggaggcctggcacaggccggggggtccctgagactctcctgtgcagcctctggattcagttttagaatgtctgccatgacctgggtcccgccaggcctccgtggggaaggggctggagtggatctcgaggggattaggtcggcacgtggcgtattatacntattanacagactccgtgaacgggccgcttcaccatctccaganactaatccaaagacacggtgtatctagacaaatgaacagacctaggagagacccggaggaccaccgggaccactataacttacngtacgacgaaaagctcgacggtcgtcggtccggcgggtacggtag

SEQ ID NO: 399252 - DNA, 662 bp, Homo sapiens
  misc_feature: GZ8MTXP02JP6Q4.4.67.G01.1.454.CMB.2.raw
  modified_base (155)..(155): a, c, t, g, unknown or other
  modified_base (179)..(179): a, c, t, g, unknown or other
  modified_base (239)..(239): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgngtttctaggtggctatttaaaggngtcagtgtgaagtgcagctggtggagtctgggggaggcctggcacagccggggggtcccngagactctctgtgcacgctcgtgtattctagtttagtatgtctcgcatcgtaccgtcggtccgccgacggcgtcggtagggagggcggtggtaggtggtacgtcgtacgtaggtaggttaggtcggtcgtacgtacggtacgtagttaataactattaattaactaacgtacgtacgtacggtacggtaacgggtaccgtaccgtaccgtacctactaccgtaccgacgaacgaactaaactaaccgtaaacgtaaacgtaacggtacgtacgtacgtacgtaacgtaaacgtaacgaacgacgacgtacgacgacggacggacggaacgaccggaccgacgtaactaacgttacgtacgtacgaacgtaaacgtaacgtacggtaccggtacggtccggtccggtaccgggtacgggtacgg

SEQ ID NO: 399253 - DNA, 623 bp, Homo sapiens
  misc_feature: GZ8MTXP02IQLRP.4.67.G01.1.454.CMB.2.raw
  modified_base (154)..(154): a, c, t, g, unknown or other
  modified_base (216)..(216): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcggngtgtttctaggtggctatttaaaggtgtcagtgtgaagtgcagctggtggagtcgtgggggnggcgtggcgacgacgggccgggggtccgtgagactctcctgtgcacgctcgtgtattctagtttagtatgtctcgcatcgtacgtcggtccgccgcggcgtcggtgggagggcggtggtaggtggtagtcgtacgtaggtagttaggtcggcgacgtggtacgtattattactattaattaataactacgtaccgtacgtacggtacgggtaccgtcctacctacctactcctaccgacgaacgaactaactaaccgaaacgaaacgtaacgtacgtactacgtacgtacgtaataacgaacgacgacgtacgagacgacgacgaacgacgaccgaactactaacttacgtacgtacgaacgaagtaacgtacgtcggtcggtcggtccggtaccggtacgggtacg

SEQ ID NO: 399254 - DNA, 591 bp, Homo sapiens
  misc_feature: GZ8MTXP02JKP8W.4.67.G01.1.454.CMB.2.raw
  modified_base (181)..(181): a, c, t, g, unknown or other
  modified_base (304)..(304): a, c, t, g, unknown or other
tcagagcactgtagcacgaccggtgctcgatttagagtatacatattgggtttgggtctgagagaggagcccagccctgggattttcaggtgttttcatttggtgatcaggactgaacagagagaactcaccatggagtttgggctgagcgtgcgttttctaggtggctattttaaaaggngtccagtgtgaagtgcagctggtggagtctgggggaggcctggcacgaggccggggggtccctgagactctcctgtgcagcctctggattcagtttagaatgtctgccatgaccctgggtccnccaggctccgtgggaagggctggagttggcgtcgtcgaggtagtagtcgcgacgtgacgtattatactatattaatacgtacgtacgtacgtacggacgggtaccgtcctaccacctactctaccacgaacgaactaactaccgaacgaacgaacggtacgtacgtactacgtacaaacgaacgaacgacgacgacgagacgacgacgacgaccgaccgacactacttacgtacgtacgacgaagaacgtacgtacggtacggtcggtaccggtacggtacggtacg

SEQ ID NO: 399255 - DNA, 616 bp, Homo sapiens
  misc_feature: GZ8MTXP02GSXIG.4.67.G01.1.454.CMB.2.raw
  modified_base (368)..(368): a, c, t, g, unknown or other
  modified_base (370)..(370): a, c, t, g, unknown or other
  modified_base (378)..(378): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaagtgcagctggtggagtctgggggaggcctggcacgaggccgggggggtccctgagactctcctgtgcagcctctggattcagtttagaatgtctgccatgacctgggtccgccaggctccgtggggaaggggctggagtggatctgagggattagtgcgatggcgtattananatattaanacgagactcgtaggacggcctctaccacctactctacgagacgactaactaccaaagaaccgtacggtagtactacgtagaactaaacgtaacgaacgacgacgtacgacggacggaccggacggaacgaccggaccgaacgtaacgtaacgttaacgtacgtacgtaacgaaacgtaacgtaccggtaccgggtccggttaccgggttacccgggtaccggggttaccggggtacgg

SEQ ID NO: 399256 - DNA, 650 bp, Homo sapiens
  misc_feature: GZ8MTXP02FR0QH.4.67.G01.1.454.CMB.2.raw
  modified_base (268)..(268): a, c, t, g, unknown or other
  modified_base (426)..(426): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctaattttaaaaggtgtccagtgtgaagtgcagctggtggagtcgtgggggaggcctggcacgaggccggggggtccctgagactctcctgtgcagccctntggattctagtttagatgtctgccatcgaccgtgggtcccgccgacggcctccggtaggggaaggggtctagggagtgggattcgtacgagggtaattggcggcacgtggctaattatactattattactacagtaccgtcgtaggaacgggtccctnttaccaccatcctaccagacaactaacttaccaaaagtactacgggttatacttaccgaacgaactaaatacgaaaccgacgtaccgtaggaacggaccggaccggacggaacccgaaccggtaccaaattaacgttaacgttacgtacggtaacggaacgtaaaacgtcgttcccggtacgggttccggttaccggggttacccgggtcggggttacggtacg

SEQ ID NO: 399257 - DNA, 522 bp, Homo sapiens
  misc_feature: GZ8MTXP02FV2XB.4.67.G01.1.454.CMB.2.raw
  modified_base (301)..(301): a, c, t, g, unknown or other
  modified_base (333)..(333): a, c, t, g, unknown or other
  modified_base (388)..(388): a, c, t, g, unknown or other
  modified_base (399)..(399): a, c, t, g, unknown or other
  modified_base (403)..(403): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctagtggctatttaaaggtgtccagtgtgaagtgcagctggtggagtctgggggaggcctggcacaggccggggggtccctgagactctcctgtgcagcctctggattcagtttagaatgtctgccatgacctgggtccncaggctccgtgggaagggctggagtggatctnaggggattaggtggcactggcgattatacatattatacagactcgtgaagggccncttcaccatcncagngacaatccaaagacacggtntatctgaanaanagacacgacagagacgacgacgacgacgacacactatactacgtacgagaagaacgtcgtcggtcgtcggtccggtcggtacggtcg

SEQ ID NO: 399258 - DNA, 519 bp, Homo sapiens
  misc_feature: GZ8MTXP02IG2R3.4.67.G01.1.454.CMB.2.raw
  modified_base (307)..(307): a, c, t, g, unknown or other
  modified_base (368)..(368): a, c, t, g, unknown or other
  modified_base (371)..(371): a, c, t, g, unknown or other
  modified_base (400)..(400): a, c, t, g, unknown or other
  modified_base (409)..(409): a, c, t, g, unknown or other
  modified_base (415)..(415): a, c, t, g, unknown or other
  modified_base (425)..(425): a, c, t, g, unknown or other
  modified_base (433)..(433): a, c, t, g, unknown or other
  modified_base (436)..(436): a, c, t, g, unknown or other
  modified_base (492)..(492): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctattttaaaaggtgtccagtgtgaagtgcagctggtggagtcgtgggggaggcctggcacgaggccgggggggtccctggagactctcctgtgcagcctctggattcagttttagaatgtctgccatgacctgggtccnccaggctccgtgggaaggggctggagtggatctcgagggattagtggcacgtggcgattanacntattatacagacctcgtggaacgggccgnttcacatcnccaganacaatccaanacacggtntanctgacaatgaacagcctgagagccgagacacggccacatatactgtacgcaaaagntcgcggctggttccgacggtccggtag

SEQ ID NO: 399259 - DNA, 529 bp, Homo sapiens
  misc_feature: GZ8MTXP02GIRHE.4.67.G01.1.454.CMB.2.raw
  modified_base (368)..(368): a, c, t, g, unknown or other
  modified_base (371)..(371): a, c, t, g, unknown or other
  modified_base (397)..(397): a, c, t, g, unknown or other
  modified_base (458)..(458): a, c, t, g, unknown or other
  modified_base (479)..(479): a, c, t, g, unknown or other
  modified_base (488)..(488): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttcttgtggctattttaaaaggtgtccagtgtgaagtgcagctggtggagtctgggggaggcctggcacaggccgggggggtccctgagactctcctgtgcagcctctggattcagttttagaatgtctgccatgacctgggtccgccaggctccgtggggaaggggctggagtggatctcaggggattagtcggcacgtggcgattanacntattatacagactcgtgaagggccgnttcaccatctccagagaacaacttccaaagaacacggtgtaatctagcaaatgaacagccngagagccgagacacggccaanactatacgngtacgacgaagaagtcgcggtcgtcggtccgcggtcggtag

SEQ ID NO: 399260 - DNA, 644 bp, Homo sapiens
  misc_feature: GZ8MTXP02F829A.4.67.G01.1.454.CMB.2.raw
  modified_base (155)..(155): a, c, t, g, unknown or other
  modified_base (226)..(226): a, c, t, g, unknown or other
  modified_base (265)..(265): a, c, t, g, unknown or other
  modified_base (267)..(267): a, c, t, g, unknown or other
  modified_base (280)..(280): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgngtttctaggtggctatttaaaaggtgtcagtgtgaagtgcagctggtggagtctgggggaggcctggcacngccgggggggtccctgagctctcctgtgcagctctggtntntagttagtatgtntgcatcgtacgtcggtccgccgcggcgtcgtgggaggggtcggtggaggtggtagtcgtcgtaggtagttaggtcggcgacgtcggtacgtattaattaactattaattaataactagtaccgtacggtacggacgggtaccgtccttacctacctactacctaccgacgaacgaactaactaacgaaacgaaacgtacggtagtactacgtagacaaacgtaacgaacgacgacgtacgacggacggaccggaacggaacgaaccgaccgaactaacttaacgttaacgtacgtacgtaacggtaaacgtaacgtacggtacggtcggttaccgggttccgggtaccgggttaccgggtacgg

SEQ ID NO: 399261 - DNA, 534 bp, Homo sapiens
  misc_feature: GZ8MTXP02IKCI8.4.67.G01.1.454.CMB.2.raw
  modified_base (307)..(307): a, c, t, g, unknown or other
  modified_base (359)..(359): a, c, t, g, unknown or other
  modified_base (367)..(367): a, c, t, g, unknown or other
  modified_base (375)..(375): a, c, t, g, unknown or other
  modified_base (399)..(399): a, c, t, g, unknown or other
  modified_base (402)..(402): a, c, t, g, unknown or other
  modified_base (407)..(407): a, c, t, g, unknown or other
  modified_base (418)..(418): a, c, t, g, unknown or other
  modified_base (425)..(425): a, c, t, g, unknown or other
  modified_base (429)..(429): a, c, t, g, unknown or other
  modified_base (431)..(431): a, c, t, g, unknown or other
  modified_base (433)..(433): a, c, t, g, unknown or other
  modified_base (436)..(436): a, c, t, g, unknown or other
  modified_base (438)..(438): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcacatggagtttgggctgagcgtggtcttttcttgtggctaattttaaaaggtgtccagtgtgaagtgcagctgggtggagtcgtgggggaggcctggcacgaggccgggggggtccctggagactctctgtgcagcctctggatcagttttagaatgtctgccatgacctgggtccnccgagctccgtgggaagggctggagtggatctgagggattagtcggcatggngattatanatattaanacagactcgagacggcctctcacntcncaganaacaatacaanaacagtntatnananaananaacacgacagagagacgacgacgacgacacaactaatactacgtacgaacgaaagaagtacgtacggtcggtcggttccggtccgggtacggtacg

SEQ ID NO: 399262 - DNA, 539 bp, Homo sapiens
  misc_feature: GZ8MTXP02J4ZRJ.4.67.G01.1.454.CMB.2.raw
  modified_base (185)..(185): a, c, t, g, unknown or other
  modified_base (221)..(221): a, c, t, g, unknown or other
  modified_base (262)..(262): a, c, t, g, unknown or other
  modified_base (265)..(265): a, c, t, g, unknown or other
  modified_base (267)..(267): a, c, t, g, unknown or other
  modified_base (274)..(274): a, c, t, g, unknown or other
  modified_base (277)..(277): a, c, t, g, unknown or other
  modified_base (291)..(291): a, c, t, g, unknown or other
  modified_base (293)..(293): a, c, t, g, unknown or other
  modified_base (295)..(295): a, c, t, g, unknown or other
  modified_base (309)..(309): a, c, t, g, unknown or other
  modified_base (316)..(316): a, c, t, g, unknown or other
  modified_base (322)..(322): a, c, t, g, unknown or other
  modified_base (324)..(324): a, c, t, g, unknown or other
  modified_base (326)..(326): a, c, t, g, unknown or other
  modified_base (330)..(330): a, c, t, g, unknown or other
  modified_base (333)..(333): a, c, t, g, unknown or other
  modified_base (345)..(346): a, c, t, g, unknown or other
  modified_base (348)..(348): a, c, t, g, unknown or other
  modified_base (358)..(358): a, c, t, g, unknown or other
  modified_base (382)..(382): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctaattttaaaaggngtccagtgtgaagtgcagctggtggagtcgtggggnggccgtggcgacgcggccgggggtcccgtgagctctcctgngcncnctctgtnttntagttagtatgtcncncntcgcgcggccgcgngcgtcgnggaggngngngtgntgngagtagtgtcgnngngatatatatntatatacagacgtcgtacgacgcnctcacactacacacgacaactaactaaccgaacgaacgtacgtagtactactacgaacaagacgacgacgacgacgacggacgacgacgacgacgacactactatacgtacgacgacgacgtaacgtcgtcggtcggtcggtccggtcggtacggtg

SEQ ID NO: 399263 - DNA, 516 bp, Homo sapiens
  misc_feature: GZ8MTXP02FODD8.4.67.G01.1.454.CMB.2.raw
  modified_base (368)..(368): a, c, t, g, unknown or other
  modified_base (394)..(394): a, c, t, g, unknown or other
  modified_base (410)..(410): a, c, t, g, unknown or other
  modified_base (430)..(430): a, c, t, g, unknown or other
  modified_base (435)..(435): a, c, t, g, unknown or other
  modified_base (455)..(455): a, c, t, g, unknown or other
  modified_base (472)..(472): a, c, t, g, unknown or other
  modified_base (480)..(480): a, c, t, g, unknown or other
  modified_base (485)..(485): a, c, t, g, unknown or other
  modified_base (491)..(491): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttcttagtggctattttaaaaggtgtccagtgtgaagtgcagctggtggagtctgggggaggcctggcacaggccgggggggtccctgagactctcctgtgcagcctctggattcagtttagaatgtctgccatgacctgggtccgccaggctcctggggaaggggctggagtggatctgagggattagtcggcactggcgattatacntattaatacagactcgtgaagggccnttcaccatctccaganacaattccaaagacacggtntatcngacaaatgaacagcctgagngccgaggacacggccanatattacngtcgngaaagngtcgcggctcggtcgcggtcggtag

SEQ ID NO: 399264 - DNA, 595 bp, Homo sapiens
  misc_feature: GZ8MTXP02HHYBL.4.67.G01.1.454.CMB.2.raw
  modified_base (289)..(289): a, c, t, g, unknown or other
  modified_base (308)..(308): a, c, t, g, unknown or other
tcagagcactgtagcacgaccggtgctcgatttagagtatacatattcgggtttggggtctgagagaggagcccagccctgggattttcaggtgttttcatttggtgatcaggactgaacagagagaactcaccatggagtttgggctgagcgtgtcgttttctaggtggctattttaaaaggtgtccagtgtgaagtgcagctggtggagtcgtgggggagcctggcacgaggccggggggtcctgagactctcctgtgcagcctctggattcagttttagaatgtcngcatcgaccgtggccgcgnggccgtcggtaggggagggcgtggaggtggatcgtacgagggtattaggcggcacgtggacgtatatactataattaataacgacgtacgtacggtacggacgggccgtctacctacctactacctaccgacgacgaactaactaaccgaaacgaaacgtacggtagtacgtactagacaaacgtaacgaacgacgacgacgacggacgacgacgacgacgaccgactactactactacgtacgaacgaagaacgtcgtcggtcgtcggtccggtccggtacggtcg

SEQ ID NO: 399265 - DNA, 590 bp, Homo sapiens
  misc_feature: GZ8MTXP02HH3PB.4.67.G01.1.454.CMB.2.raw
  modified_base (258)..(259): a, c, t, g, unknown or other
  modified_base (266)..(266): a, c, t, g, unknown or other
  modified_base (268)..(268): a, c, t, g, unknown or other
  modified_base (283)..(283): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctattttaaaaggtgtcagtgtgaagtgcagctggtggagtcgtgggggaggcctggcacagccggggggtcctgagactctcctgtgcnnctctgtntntagttagtatgtctncatcgtaccgtcggtccgcgcgtcgtcggtagggacgggcggtggaggtggtagtcgtacgtaggtagtagtcgacgacgtcgtacgtatatactataattaactaacgtacgtacgtacggtacgggacggtccgtcctacctacctactacctaccgacgaacgaactaactaaccgaacgaacgtacgtagtacgtactacgacaactaagaacgacgacgagacgacgacgacgacgacgacactactactacgtacgtacgagacgtaacgtcgtcggtcgtcggtcggtcggtacggtacg

SEQ ID NO: 399266 - DNA, 658 bp, Homo sapiens
  misc_feature: GZ8MTXP02JXPVT.4.67.G01.1.454.CMB.2.raw
  modified_base (301)..(301): a, c, t, g, unknown or other
  modified_base (413)..(413): a, c, t, g, unknown or other
  modified_base (465)..(465): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttctgtggctattttaaaggtgtccagtgtgaagtgcagctggtggagtctgggggaggcctggcacgaggccgggggggtcctgagactctcctgtgcagcctctggattcagtttagatgtctgccatgacctgggtccncaggctccgtggggaagggctgggagtggatctgaggggtattaggcggcacgtggacgtattatacattattatacagtactccgtaggaacggggccctcttccaacctntccgtacccaaggaacactaaacttacccaaaggtaaaccctacgggggttntttaataccgttaggaacctaaaacgtaacgaacgaacgacgtacggacggacggaccggaacggaacggaaccggaccgaacgtaacgttaacgttaacgtacgtacggtaacggtaaacggtaacggtaccggttaccggggttaccgggttaccgggttacccggggttaccggggttaccggggtacgg

SEQ ID NO: 399267 - DNA, 587 bp, Homo sapiens
  misc_feature: GZ8MTXP02HXCF2.4.67.G01.1.454.CMB.2.raw
  modified_base (374)..(374): a, c, t, g, unknown or other
  modified_base (384)..(384): a, c, t, g, unknown or other
  modified_base (408)..(408): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaggtgtccagtgtgaagtgcagctggtggagtcgtgggggagcctggcacgaggccggggggtcctggagactctcctgtgcagcctctggattcagttttagaatgtctgccatgaccgtgggtcccgccaggctccgtaggggaaggggctgggagtggatcgtcgagggtattagtcggcacgtggcgtattanacattattanacagtacctcgtagaacgggcccnctcaccatcctcccagacgactaaactaccccaaagaaccacggtagtactacgtagaccaaagtacgaaacacgccgtagaagacgacccggaaggaccaccggacctaacattacgttaactggtacgacgaaaagtcgtcgacgggtcctcgggttcccggcgggttaccggtaag

SEQ ID NO: 399268 - DNA, 594 bp, Homo sapiens
  misc_feature: GZ8MTXP02GKBOI.4.67.G01.1.454.CMB.2.raw
  modified_base (305)..(305): a, c, t, g, unknown or other
  modified_base (455)..(455): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtcgtgggggaggcctggcacgaggccgggggggtccctgagactctcctgtgcagcctctggattcagttttagatgtctgccatgacctgggtcccnccgaggcctccgtggggaaggggctgggagtggatcgtcgaggggtattaggcggcacgtggacgtattatacatattatacagtacctcggtagaacgggccgcttccaccatcctaccagacgaacaattacccaaagaacacgggtntaactctagacaaaagtcgaaaactgcctaggaacggacgacccggaaggaccaccgggtaccaaactattacttaacgtgtacgacgaaagaacgttccggtacggggtcttcgggttcccggcgggttaccgggtag

SEQ ID NO: 399269 - DNA, 522 bp, Homo sapiens
  misc_feature: GZ8MTXP02JF900.4.67.G01.1.454.CMB.2.raw
  modified_base (243)..(243): a, c, t, g, unknown or other
  modified_base (270)..(270): a, c, t, g, unknown or other
  modified_base (353)..(353): a, c, t, g, unknown or other
  modified_base (390)..(390): a, c, t, g, unknown or other
  modified_base (410)..(410): a, c, t, g, unknown or other
  modified_base (426)..(426): a, c, t, g, unknown or other
  modified_base (428)..(428): a, c, t, g, unknown or other
  modified_base (433)..(433): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttctaggtggctattttaaaaggtgtccagtgtgaagtgcagctggtggagtctgggggagcctggcacagccgggggggtccngagactctcctgtgcagctctggatcngtttagaatgtctgccatgctggtcgcagctcctggagggcgtggagtggagtctcaggagtagtggcgactggcggatatanatattatacagaactccgtgaaaggcgcttcaccaanctcccagaacactactacanacgacgtagtatctananaatanacacgacgagagacgacgacgacgacgacacactactacgtacgtacgacgaagaacgtcgtcggtcgtcggtcggtcggtacggtacg

SEQ ID NO: 399270 - DNA, 574 bp, Homo sapiens
  misc_feature: GZ8MTXP02HVJ2E.4.67.G01.1.454.CMB.2.raw
  modified_base (488)..(488): a, c, t, g, unknown or other
  modified_base (527)..(527): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttctgtggctattttaaaaggtgtccagtgtgaagtgcagctggtggagtcgtgggggaggcctgggcacgaggccgggggggtccctgagactctcctgtgcagcctctggattcagtttagaatgtctgccatggcctgggtcccgccgaggctccgtggggaaggggcgtggaggtggatcgtcgaaggggtattacggtggctacgtgggacgtattactacattattaatacagtactccgtagaaacggggcccgtcttccaacctatcctaccagagaacaaacttccaaagaacgacggtgtatcttagacaaaagtgaaacngacctggaacgagaccgaggaccacggccacatattacngtagacgaaagctacgtcgggctcgggtcccggcggttaccgggtag

SEQ ID NO: 399271 - DNA, 543 bp, Homo sapiens
  misc_feature: GZ8MTXP02FI3EM.4.67.G01.1.454.CMB.2.raw
  modified_base (355)..(355): a, c, t, g, unknown or other
  modified_base (492)..(492): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctggcacgaggcccgggggggtccctgagactctcctgtgcagcctctggattcagttttagaatgtctgccatgacctgggtcccgccaggctccgtggggaaggggctgggagtggatctcgaggggattaggnggcacgtgggcgtattatacatattatacagacttcgtgaacgggccgcttccaccatctcccagacgacaattccaaagaacacggtgtaatctgacaaatgaaccgctgagagccgagacacggcacatactacngtcgacgaaagatcgtcgggcttcgggtcccgtcgggtcccgggatttcgg

SEQ ID NO: 399272 - DNA, 549 bp, Homo sapiens
  misc_feature: GZ8MTXP02F3499.4.67.G01.1.454.CMB.2.raw
  modified_base (268)..(268): a, c, t, g, unknown or other
  modified_base (306)..(306): a, c, t, g, unknown or other
  modified_base (351)..(351): a, c, t, g, unknown or other
  modified_base (353)..(353): a, c, t, g, unknown or other
  modified_base (355)..(355): a, c, t, g, unknown or other
  modified_base (360)..(360): a, c, t, g, unknown or other
  modified_base (362)..(362): a, c, t, g, unknown or other
  modified_base (367)..(367): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctagtggctattttaaaaggtgtccagtgtgaagtgcagctggtggagtctgggggaggcctggcacgaggccgggggggtccctgagactctcctgtgcagccctntggattcagtttagaatgtctgccatgacctgggtccncaggctccgtgggaagggctggagtggatctgaggattaggcgcngngntatanantatanacagtactcgagacggcctctacacactcacagacaactaactacgaaagacgtaggtatatctagacaataagaacgacgacgagacgacggacgacgaacgaccgaccgactaactactacgtacgtacgaacgaacgaacgtacgtacggtcggtcggtccggtaccgggtacggtacg

SEQ ID NO: 399273 - DNA, 594 bp, Homo sapiens
  misc_feature: GZ8MTXP02HP3T3.4.67.G01.1.454.CMB.2.raw
  modified_base (385)..(385): a, c, t, g, unknown or other
  modified_base (395)..(395): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaagtgcagctggtggagtcgtgggggagcctggcacgaggcccggggggtccctgagactctcctgtgcagcctctggattctagttttagaatcgtctgccatcgaccgtggtcccgccgaggctccgtaggggagggcgtggagtggatcgtgagggtattaggcggctacgtgggactattaactanattatttaanacgtacgtaccgtacggtacggaccggtcctcctaccacctactcctacgaagactaactaacgtaccgaaacgtaacgtacggtatatactagacaactacgaacgacgacgagacgacgacgacgacgacgacactactactacgtacgtacgacgaacgtaacgtcgtcggtcggtcggtccggtcggtacggtcg

SEQ ID NO: 399274 - DNA, 582 bp, Homo sapiens
  misc_feature: GZ8MTXP02F9K48.4.67.G01.1.454.CMB.2.raw
  modified_base (303)..(303): a, c, t, g, unknown or other
  modified_base (313)..(313): a, c, t, g, unknown or other
  modified_base (376)..(376): a, c, t, g, unknown or other
  modified_base (408)..(408): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaggtgtccagtgtgaagtgcagctggtggagtcgtgggggaggcctggcacgaggccgggggggtccctgagactctcctgtgcagcctctggattcagtttagaatgtctgccatgacctgggtccncaggctccgnggggaaggggctgggagtggatcgcgaggggtattaggtcggctacgtgggactattacaatntattataacagtacctcgtaggaacgggcctnttccactatcctaccaagacgaactaacttacccaaagaaccacgggttataatctagaactaaagtacgaaacacgccctaggacgagaccggaggtacacggaccatactattactagacgaccgaaaagtctacggtcgggtcctcggtttccggaccgggttacggtacg

SEQ ID NO: 399275 - DNA, 700 bp, Homo sapiens
  misc_feature: GZ8MTXP02IIRG3.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccgggggggtccctggagactctcctgtgcagcctctggattcagttttagaatgtctgccatgaccgtgggtcccgccgaggcctccgtggggaaggggctgggagtggatcgtcgagggtattaggcggacacgtggcgtattataacattaattaatacagacctccgtagaaacggggccctcttaccacccagttccctacccgaagacgaaacctaaacttccccgaaaagtaaaccgaccgggttgtaaacttccttaggaacctaaaaagtcgaaaaccgacgtacccgtaggaacggaaccggaccccgggaaaagggaaaccccgaaccggggaccccttaaacgaaactttaaacgtttaccgtaggtacggaaaccggtaaaaagtcgttcccgggttacgggggtacccgttcgggggtttcccccgggaacgggggtttccccggggttaaagg

SEQ ID NO: 399276 - DNA, 521 bp, Homo sapiens
  misc_feature: GZ8MTXP02JDC1K.4.67.G01.1.454.CMB.2.raw
  modified_base (305)..(305): a, c, t, g, unknown or other
  modified_base (364)..(364): a, c, t, g, unknown or other
  modified_base (367)..(367): a, c, t, g, unknown or other
  modified_base (394)..(394): a, c, t, g, unknown or other
  modified_base (450)..(450): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcttttcttgtggctattttaaaaggtgtccagtgtgaagtgcagctggtggagtctgggggaggcctggcacaggccgggggggtccctggagactctcctgtgcagcctctggattcagttttagaatgtctgccatgacctgggtccnccaggctccgtgggaggggctggagtggatctcgagggattagtggcactggcgattanacntattatacagactcgtgaacgggccgnttcacatctccagacgacaattaccaaagacaaggtcgtatctagacaaatgaacngcctgagagccgagacacggcacatatactgacgagaaagcgtacgtcggctcggtccgcggtaccggtag

SEQ ID NO: 399277 - DNA, 608 bp, Homo sapiens
  misc_feature: GZ8MTXP02IDGOG.4.67.G01.1.454.CMB.2.raw
  modified_base (278)..(278): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggagcctggcacgaggccggggggtcctgagactctctgtgcagcctctggattcagttttanaatgtctgccatgacctgggtcccgcaggctccgtggggaagggctggagtggatctacgagggtattaggtggcacgtggcgtattatacatatttaatacagtacctccggtagaacgggcccgtcttaccacccatcctcccaagacgaacaaacttacccgaaagaaccgtacgggtagttaactcttagacaaaagtcgaaaccagtcctaggaacgacggaccggaacggaaccgaccggaccaactaattaacttaacgtcgtacgacggaaaagccgttacgtccgggtcgttcggggttacccggcgggttacccgggtag

SEQ ID NO: 399278 - DNA, 540 bp, Homo sapiens
  misc_feature: GZ8MTXP02HZ4LK.4.67.G01.1.454.CMB.2.raw
  modified_base (262)..(262): a, c, t, g, unknown or other
  modified_base (306)..(306): a, c, t, g, unknown or other
  modified_base (373)..(373): a, c, t, g, unknown or other
  modified_base (403)..(403): a, c, t, g, unknown or other
  modified_base (416)..(416): a, c, t, g, unknown or other
  modified_base (444)..(444): a, c, t, g, unknown or other
  modified_base (495)..(495): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttcttgtggctattttaaaaggtgtccagtgtgaagtgcagctggtggagtcgtgggggaggcctggcacgaggccgggggggtccctgagactctcctgtgcngcctctggattcagtttagaatgtctgccatgacctgggtcccnccaggctccgtggggaaggggctgggagtggatctcgagggattaggtggcacgtggcgattatacnttattatacagtactccgtagaacgggccncttcacctatccnccagacgacaaattccaagaacacggtnatctagacaatgaacagcctgagagccgaggacacggctacactattacgngtacgacgaagtcgtcgtcggtcgtcggtccggtcggtacggtag

SEQ ID NO: 399279 - DNA, 560 bp, Homo sapiens
  misc_feature: GZ8MTXP02H89KY.4.67.G01.1.454.CMB.2.raw
  modified_base (307)..(307): a, c, t, g, unknown or other
  modified_base (369)..(369): a, c, t, g, unknown or other
  modified_base (404)..(404): a, c, t, g, unknown or other
  modified_base (472)..(472): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctattttaaaaggtgtccagtgtgaagtgcagctggtggagtcgtgggggaggcctgggcacgaggccgggggggtccctgagactctcctgtgcagccctctggattcagttttagaatgtctgccatgacctgggccncaggctccgtggggaggggctggagtggatctcgaggggattggcggcacgtggcgtattanacattattatacagtacctcggtgaacgggcccgnttccaccatcctccaagacgaactaaattacccaaagaacgacggtataatctagacaaagtgaaacncgctagacgacgacgagaccgacgacacactactacgtgacgacgaaagtcgtcggtcgggtcgttcggtccggtacgggtacggtag

SEQ ID NO: 399280 - DNA, 688 bp, Homo sapiens
  misc_feature: GZ8MTXP02JAO7Q.4.67.G01.1.454.CMB.2.raw
  modified_base (342)..(342): a, c, t, g, unknown or other
  modified_base (355)..(355): a, c, t, g, unknown or other
  modified_base (375)..(375): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccggggggtccctgagactctcctgtgcagcctctggattcagtttagaatgtctgccatgaccgtgggtcccgccgacggctccgtggggaaggggctggagtggatcncgagggattaggnggcacgtggcgtattatacnttattaatacgagaccgtccggtaggaacggggtcccgctttccgaacccattccctacccgagacgaactaaacttacccaaaagaacctacggggttatacttaccgtagaaccctaaaattcggaaaactcggaccctagggaaacggaccggacccgggaagggaaccccgaccgggacccaaacggtaactttacgtttaaacccgtggtaaaccggacgttaaaaaacggtcgttacccggttaccggggggtaccgtttaccgggggtttacccccggccgggggtttaccccgggggtttaaagg

SEQ ID NO: 399281 - DNA, 592 bp, Homo sapiens
  misc_feature: GZ8MTXP02F5ZN1.4.67.G01.1.454.CMB.2.raw
  modified_base (261)..(261): a, c, t, g, unknown or other
  modified_base (272)..(272): a, c, t, g, unknown or other
  modified_base (287)..(287): a, c, t, g, unknown or other
  modified_base (489)..(489): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctaattttaaaaggtgtcagtgtgaagtgcagctggtggagtctgggggaggcctggcacaggccggggggtcccgtgagactctcctgtgcncgctctgtatntagttagtatgtctncatcgtacgtcggtccgcgacggtcgtcggtagggacggtggtaggtaggtgtacgtcgtagtaggtagtaggtcgacgtacgtgtacgtatatatataataactaacgtacgtacgtacggtacggacggtccgtactacctactactacacgacgaactaactaactaacgaacgaacgtacgtagtacgtacgtagaanaagaacgaacgacgacgagacgacgacgacgacgacgacactactacgtacgtacgtacgaagacgtaacgtcgtcggtcggtcggtcggtacggtacggtcg

SEQ ID NO: 399282 - DNA, 686 bp, Homo sapiens
  misc_feature: GZ8MTXP02I3ICW.4.67.G01.1.454.CMB.2.raw
  modified_base (306)..(306): a, c, t, g, unknown or other
  modified_base (376)..(376): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttcttgtggctattttaaaaggtgtccagtgtgaagtgcagctggtggagtcgtgggggaggcctggcacgaggccggggggtccctgagactctcctgtgcagcctctggattcagttttagaatgtctgccatcgacctgggtccnccgaggcctccgtggggaagggctggagtggatcgtcgagggattagtcggacacgtggcgtattatacnttattactacagtacctccggtagaaacgggcccgtcttaccaacctacttccctacccgaagacgaaacctaaactttacccaaaagtaaaccgtaaccggggttagttaaactaccgttaggaacccaaaagttacggaaaaccctaggtaccccgtaggaacggaacgacccgggaaagggacccgaaccgggacccaaactaaacttaaacgtttaccgttaggtaacgaaccggtaaaaagtcgttaacccgtcgggggtaacctttacggggttaccccggcgggggttacccgggtttaacgg

SEQ ID NO: 399283 - DNA, 389 bp, Homo sapiens
  misc_feature: GZ8MTXP02FOWG6.4.67.G01.1.454.CMB.2.raw
  modified_base (320)..(320): a, c, t, g, unknown or other
  modified_base (384)..(389): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtctggtcagcccaaggcccaaccccntgtcactctcgttcccgccccctcctcctacagtcgctctgacgcgggctggcaaggcgcatgnnnnnn

SEQ ID NO: 399284 - DNA, 533 bp, Homo sapiens
  misc_feature: GZ8MTXP02FWD03.4.67.G01.1.454.CMB.2.raw
  modified_base (338)..(338): a, c, t, g, unknown or other
  modified_base (364)..(364): a, c, t, g, unknown or other
  modified_base (372)..(372): a, c, t, g, unknown or other
  modified_base (438)..(438): a, c, t, g, unknown or other
  modified_base (443)..(443): a, c, t, g, unknown or other
  modified_base (445)..(445): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctattttaaaaggtgtcagtgtgaagtgcagctggtggagtcgtgggggaggcctggcacaggccggggggtccctgagactctcctgtgcagcctctggattcagtttagtaatgtctgccatgacctggtccgccaggctcctggaaggggcgtggagtggagtctnaggagtagtggcactggcgatatacntattatanagactcgtgaaggccgcttcaccactctcccagagacaattacaaacgaacaacgtagtatcttanacaananacacgacagagacgacgacgacgacgacacactatactacgtacgacgaagaacgtcgtacggtcgtcggtcggtccggtacggtacg

SEQ ID NO: 399285 - DNA, 591 bp, Homo sapiens
  misc_feature: GZ8MTXP02JV2WD.4.67.G01.1.454.CMB.2.raw
  modified_base (314)..(314): a, c, t, g, unknown or other
  modified_base (471)..(471): a, c, t, g, unknown or other
  modified_base (542)..(542): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtggggggaggcctggcacgaggcccgggggggtccctggagactctcctgtgcagccctctggattcagttttagaatgtctgccatgacctgggtcccncaggctccgtggggaggggctgggagtggatcgtacgaggggtattaggtcggcacgtgggacgtattatacattattatacagtactccggtagaaacggggccctcgttacaccctatcctacccaagacgaacaaattaccaaagaacacggtntaatctagactaaatcgaaacacggcctaggagacggacccgaaggaccaccgggaccaactatacttacngtacgacgaaaagcgtcgtcggggctcgggttcccgcgggttacggtag

SEQ ID NO: 399286 - DNA, 550 bp, Homo sapiens
  misc_feature: GZ8MTXP02HVCUO.4.67.G01.1.454.CMB.2.raw
  modified_base (309)..(309): a, c, t, g, unknown or other
  modified_base (356)..(356): a, c, t, g, unknown or other
  modified_base (376)..(376): a, c, t, g, unknown or other
  modified_base (403)..(403): a, c, t, g, unknown or other
  modified_base (441)..(441): a, c, t, g, unknown or other
  modified_base (457)..(457): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctggtggctaattttaaaaggtgtccagtgtgaagtgcagctggtggagtcgtgggggaggcctggcacgaggccgggggggtccctggagactctcctgtgcacgctctggattcagttttagaatgtctgccatgacctgggtccncgaggctccgtggggaagggctgggagtggatcgtcgagggattagnggcacgtggacgtattacanttattatacagactcgtgaacgggccnctcacatctcccagacactaataccaaagaaccaggtntaactctagactaaanagaacgagacagagagacgacgacgacggacacactattactacgtacgacgaagaagtcgtacggtcgtcggtccggtcggtaccggtacgg

SEQ ID NO: 399287 - DNA, 616 bp, Homo sapiens
  misc_feature: GZ8MTXP02H24JP.4.67.G01.1.454.CMB.2.raw
  modified_base (337)..(337): a, c, t, g, unknown or other
  modified_base (378)..(378): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctagtggctattttaaaaggtgtccagtgtgaagtgcagctggtggagtcgtgggggaggcctgggcacaggccgggggggtccctggagactctcctgtgcagcctctggattcagttttagatgtctgccatgacctgggtccgccaggctccgtggaggggctggagtgganctcgagggattagtggcagtggcgattacacattatttaanacagtaccgtcggtaggacggcctctaccgactactcctaccgagacgaactaataccgaaagaacgtacggtatactcgtagaactaaagtacgaaacgacgacgtagaacgaacggaccggaacggaaccgaaccggaccgaactaactaaacgttaacgtacgtacgtaacgtaaaacgtaacgtacggtaccgggtcggttaccgggttaccggtccggggttaccgggtacgg

SEQ ID NO: 399288 - DNA, 621 bp, Homo sapiens
  misc_feature: GZ8MTXP02GRMN3.4.67.G01.1.454.CMB.2.raw
  modified_base (210)..(210): a, c, t, g, unknown or other
  modified_base (257)..(257): a, c, t, g, unknown or other
  modified_base (264)..(264): a, c, t, g, unknown or other
  modified_base (266)..(266): a, c, t, g, unknown or other
  modified_base (279)..(279): a, c, t, g, unknown or other
  modified_base (281)..(281): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgtttctaggtggctattttaaaaggtgtccagtgtgaagtgcagctggtggagtntggggaggcctggcacagcggggggtcccgtgagactctcctgtgcngctctgntntagttagtatgtntncatcgcgtcggtccgcgcgcgtcgtggagggtcgtggagtggagtcgtacgtaggtagttaggtcggcgtacgtggtacgtattactaactataattaataacgtacgtacgtacgtacggacgggtccgtaccttacctacctactacctaccgtacgaacgtaactaactaacgaaacgtaaacgtaacggtagtacgtactagacgtaaacgtaacgaacgaacgacgtacgaacgacggaccggacggaacgacgaccgaactaactaacgttacgtacgtacgaacgaaacgtaacgtacgtacggtcggtacggtccggtaccggtacggtacg

SEQ ID NO: 399289 - DNA, 717 bp, Homo sapiens
  misc_feature: GZ8MTXP02HPLE9.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccgggggggtccctgagactctcctgtgcagcctctggattcagttttagaatgtctgccatgacctgggtcccgccgaggctccgtggggaaggggctgggagtggatcgcgaggggtattaggtcggcacgtggcgtattatacatattatacagtactccggtagaacggggcccgtacttccaccctaattccctacccgaaggaacgaacctaaacgtttaccccaaaaggaacccgtacgggttagttaacttaccgttaggaacccaaaagttacggaaaacctacggaccccttaagggaacggaacggacccccggggaaagggaaccccggaaccggggtacccccaaacggtaaaactttaacgtttaaacccgtggttacggaaccggtaaaaaaggtaacgttacccggttaccgggggtccgtttacgggggtttacccccgggtccgggggtttaccccgggggttaaag

SEQ ID NO: 399290 - DNA, 625 bp, Homo sapiens
  misc_feature: GZ8MTXP02IR8W2.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctaattttaaaaggtgtcagtgtgaagtgcagctggtggagtcgtgggggagcctggcacgaggccggggggtcctgagctctcctgtgcagctctggattctagttagtatgtctcgcactcgtacgtcggtccgccgcgcgtcggtgggagggcggtggaggtggtagtcgtcgtaggtagtaggtcggcgacgtgtacgtattaattaactattaattaataacgtacgtacgtacgtacggtaacgggtaccgtaccgtacctacctactacctaccgaacgaacgtaacgtaactaaccgtaaacgtaacgtaacggtacgtacgtacgtacgaacgtaaacgtaacgaacgacgacgacgacgacgacgacgaacgaccgacgactactacgttacgtacgtacgaacgaagtaacgtacgtacggtcgtcggtccggtcggtacggtacg

SEQ ID NO: 399291 - DNA, 550 bp, Homo sapiens
  misc_feature: GZ8MTXP02IQYWM.4.67.G01.1.454.CMB.2.raw
  modified_base (307)..(307): a, c, t, g, unknown or other
  modified_base (374)..(374): a, c, t, g, unknown or other
  modified_base (478)..(478): a, c, t, g, unknown or other
  modified_base (508)..(508): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggctattttaaaaggtgtccagtgtgaagtgcagctgggtggagtctgggggaggcctggcacgaggccgggggggtccctggagactctcctgtgcagcctctggattcagttttagaatgtctgccatgacctgggtccnccaggctccgtggggagggctggagtggatcgtcgaggggtattagtcggcacgtggcgattatacnttattatacagaccgtccgtagaacgggcctctcaccatctccagacactaattaccaaagaactacggtagtatcgtagactaaatgaaaccagcctagacgngaccgaggaccacggtccatactattacgngtacgacgaaagaatccgtcggctggtccgcgggtccggtag

SEQ ID NO: 399292 - DNA, 638 bp, Homo sapiens
  misc_feature: GZ8MTXP02HMQ81.4.67.G01.1.454.CMB.2.raw
  modified_base (383)..(383): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtccctgagactctcctgtgcagcctctggattcagttttagaatgtctgccagtcgaccgtgggtcccgccgaggcctccgtggggaaggggctgggagtggatcgtcgagggtattaggcggcacgtggacgtattactanattaatttatacgacgtaaccgtcggtaggaaacggggcccgtcttaccaccctacgtccttcccgaaagaccgaaactaaacgtttacccgaaaagaaccgtaacggggttattaactccgttagaactaaaagtacgaaaccagacccgtagacgacggaccggaaggaccgacggaccaactattaacttacgtagtacgaacgaaagtaacgtcggtacgggtcgtcgggtaccggcgggttaccggtagg

SEQ ID NO: 399293 - DNA, 403 bp, Homo sapiens
  misc_feature: GZ8MTXP02GR48Q.4.67.G01.1.454.CMB.2.raw
  modified_base (337)..(337): a, c, t, g, unknown or other
  modified_base (382)..(382): a, c, t, g, unknown or other
  modified_base (389)..(403): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcagggtccctgatcgcttctctggctccaagtctggcaacatggcctccctgaccatctctgggctccaggctgaggatgaggctgattactactgctgctccttgcaggcgcctctgtctcaggcagctatgtcttcggaactgggaccgaagtgaccgtcctgggtcagccccaaggccaaccccatgtcactctcgttcccnccccctcctcctacagtcgcctctgacgcggggctgggcaaggcncaagtgnnnnnnnnnnnnnnn

SEQ ID NO: 399294 - DNA, 572 bp, Homo sapiens
  misc_feature: GZ8MTXP02HDTQV.4.67.G01.1.454.CMB.2.raw
  modified_base (387)..(387): a, c, t, g, unknown or other
  modified_base (462)..(462): a, c, t, g, unknown or other
  modified_base (492)..(492): a, c, t, g, unknown or other
  modified_base (513)..(513): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcttttctagtggctattttaaaggtgtcagtgtgaagtgcagctggtggagtcgtgggggaggcctggcacgaggccgggggggtccctgagactctcctgtgcagcctctggattcagttttagaatgtctgccatcgaccgtgggtcccgccgaggcctccgtggggaaggggctgggagtggatcgtgaggggtattaggtcggcacgtgggacgattatacatattanacagactcggtgaacgggccctcttaccaccatcctacccgagacgaactaacttacccaaagaacgtacgggtntactcgtagacaaatgaacagcctgaacgngaccgaggaccacggacccanattacttacgcgtacgacgaagcgtcgtcgggtcgtcgggtccggacgggttacggtag

SEQ ID NO: 399295 - DNA, 637 bp, Homo sapiens
  misc_feature: GZ8MTXP02GQCIP.4.67.G01.1.454.CMB.2.raw
  modified_base (304)..(304): a, c, t, g, unknown or other
  modified_base (384)..(384): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcttttcttgtggctattttaaaaggtgtccagtgtgaagtgcagctggtggagtcgtgggggaggcctggcacgaggccggggggtccctgagactctcctgtgcagcctctggattcagtttagaatgtctgccatgacctgggtccnccaggctccgtggggaaggggctggagtggatcgtcgaggggatttaggcggcacgtggacgtattatactattaattanaacagtacctcggtaggaacgggccctactcacctactccaccgaagacgaactaactaccgaaagaaccgtacggttatactctagaacaaaagtacgaaacacgaccgtaggaacggacggacccggaaacggaacccgaaccggtacccaaataaacgttaacttaacgtacggttacgaaacggaaaagtcgttaccggtaccggggtccgttaccggggttccccgggtaccggggttaccgggtaag

SEQ ID NO: 399296 - DNA, 535 bp, Homo sapiens
  misc_feature: GZ8MTXP02GILRS.4.67.G01.1.454.CMB.2.raw
  modified_base (303)..(303): a, c, t, g, unknown or other
  modified_base (368)..(368): a, c, t, g, unknown or other
  modified_base (414)..(414): a, c, t, g, unknown or other
  modified_base (454)..(454): a, c, t, g, unknown or other
  modified_base (502)..(502): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctggcacaggccgggggggtccctgagactctcctgtgcagcctctggattcagtttagaatgtctgccatgacctgggtcccnccaggctccgtggggaagggctggagtggatcgtcgaggggattaggtggcacgtggcgtattanacatattatacagacctcgtgaacgggccgcttcaccatctcaganacaattcccaaagaacacggtgtatctgacaaatgaaacngacctgagagaccgagacacggcacactattactgtacgacgaaaagntacgtcgggctcgggttccgcgggtaccggtag

SEQ ID NO: 399297 - DNA, 393 bp, Homo sapiens
  misc_feature: GZ8MTXP02FO1EU.4.67.G01.1.454.CMB.2.raw
  modified_base (384)..(393): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccaagtgaccgtcctggtcagcccaaggcccaaccccatgtcactctcgttccccaccccctcctcctacagtgctctgagcgggctggcaaggcgcatagnnnnnnnnnn

SEQ ID NO: 399298 - DNA, 624 bp, Homo sapiens
  misc_feature: GZ8MTXP02JH9ZK.4.67.G01.1.454.CMB.2.raw
  modified_base (373)..(373): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttcttgtggctaattttaaaaggtgtccagtgtgaagtgcagctggtggagtcgtgggggaggcctggcacgaggccgggggggtccctgagactctcctgtgcagcctctggattcagttttagatgtctgccatgacctgggtccgccaggctccgtggggaagggctggagtggatctcgaggtattaggtcggcacgtggacgtattanacatatatacagactccgtagaacgggcccgtcttaccacctatcctacccagaacgacctaaattaccgaaaagaacgaccgggtataacttccgtagacctaaaacgtagaaacccgaagccctaggaacgaacggacccgaagggaacccacccgggaccaaacctaaataacgttactagtacgaccgtaaaaaggcttccggtacggggtcgtggggtttccccggcggggttcccggggttaacg

SEQ ID NO: 399299 - DNA, 412 bp, Homo sapiens
  misc_feature: GZ8MTXP02HEOG1.4.67.G01.1.454.CMB.2.raw
  modified_base (399)..(412): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccaagtgaccgtcctgggtcagccccaaggccaaccccatgtccactctcgttccccgccccctcctacctacagtgccttctggacgcggggctcgggacgaacggcgacaatagnnnnnnnnnnnnnn

SEQ ID NO: 399300 - DNA, 558 bp, Homo sapiens
  misc_feature: GZ8MTXP02HWYJL.4.67.G01.1.454.CMB.2.raw
  modified_base (182)..(182): a, c, t, g, unknown or other
  modified_base (259)..(260): a, c, t, g, unknown or other
  modified_base (267)..(267): a, c, t, g, unknown or other
  modified_base (269)..(269): a, c, t, g, unknown or other
  modified_base (282)..(282): a, c, t, g, unknown or other
  modified_base (284)..(284): a, c, t, g, unknown or other
  modified_base (286)..(286): a, c, t, g, unknown or other
  modified_base (307)..(307): a, c, t, g, unknown or other
  modified_base (318)..(318): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcggtgtgtttctaggtggctattttaaaaggngtcagtgtgaagtgcagctggtggagtcgtgggggaggcctggcacgagccgggggggtcctgagctctcctgtgcnnctctgtntntagttagtatgtntncntcgcgtcggcgcgcgcgtcgnggaggcgtggngtgtgtgtgaggtagtagtcgcgacgtgagtatatatatataatactacgtacgtacgtacgacggtaccgtctacctactactactacgacgaacgtaactaactaaccgaaacgaacgtacgtacgtacgtacgtacgtactaataacgaacgacgacgagagacgacgacgacgacgacacactactacgtacgacgacgaagtaacgtacgtcgtcgtcggtcggtcggtcggtcg

SEQ ID NO: 399301 - DNA, 656 bp, Homo sapiens
  misc_feature: GZ8MTXP02G346G.4.67.G01.1.454.CMB.2.raw
  modified_base (358)..(358): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaggtgtccagtgtgaagtgcagctggtggagtcgtgggggaggcctggcacgaggccggggggtcctgagactctcctgtgcagcctctggtattctagttttagaatgtctgccatcgacctgggtccgccaggcctccgtggggaagggcgtggagtggatcgtcgagggtattaggnggcacgtggacgtattaatacattataatacagtacctccggtggaaacgggtcccgacttaccgaccctatccctacccgagtaaccgaactaaacgttaacccaaacgaaaccgtaaccggttagttaaacgtcccgttaagacccgtaaaagttacgaaaaccgtacgacccgttaggaacgacggaccggaaacgggaccaccgggacccaagaacttacttaaccgtggtacgaacgtaaaacggtgtccggtacgggtcgttacggttcccgggccgggtaccggttaacgg

SEQ ID NO: 399302 - DNA, 606 bp, Homo sapiens
  misc_feature: GZ8MTXP02GK2CT.4.67.G01.1.454.CMB.2.raw
  modified_base (371)..(371): a, c, t, g, unknown or other
  modified_base (452)..(452): a, c, t, g, unknown or other
  modified_base (479)..(479): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccgggggggtccctgagactctcctgtgcagcctctggattcagttttagaatgtctgccatgacctgggtccgccaggctcgtgggaagggctggagtggatctcgagggtattaggtggctacgtggacgtattanactatattaatacagacctcgtaggaacgggccgtcttccaccatcctaccagacgaacaattaccaaagaactacgggtntaactctagactaaaagtcgaaaaccncgtacgtaggacgacggaccgaacggaacccgaccggacctaactaaacgttacttaacgtcgtacgaacgaaagtaacgtccgggtacggtacgttccggggtcccggtaccggggttaccggtag

SEQ ID NO: 399303 - DNA, 596 bp, Homo sapiens
  misc_feature: GZ8MTXP02JB7B5.4.67.G01.1.454.CMB.2.raw
  modified_base (281)..(281): a, c, t, g, unknown or other
  modified_base (470)..(470): a, c, t, g, unknown or other
tcagagcactgtagcacgaccggtgctcgatttagagtatacatattgggtttggggtctgagagaggagcccagccatgggattttcaggtgttttcatttggtgatcaggactgaacagagagaactcaccatggagtttgggctgagctggtctttttctgtggctaattttaaaaggtgtccagtgtgaagtgcagctggtggagtcgtgggggaggcctggcacgaggccggggggtccctgagactctcctgtgcagcctctggattcagtttanaatgtctgccatgaccgtgggtccgccgaggcctccgtggggaaggggctgggagtggatcgtcgaggggtattaggtggctacgtgggcgtaattatactattattatacagtactccgtgaaacgggccgcttaccgacctatccctaccgagaacgaacaattacccgaaagaaaccgtacgggtnttaactcctagacctaaaagtcgaaaactcggacctagacgacgacccgaggaccgaccggccaacgattaatactacgtgaacgaaagtactcgtccgggcttacggggttcccgcggttaccgg

SEQ ID NO: 399304 - DNA, 605 bp, Homo sapiens
  misc_feature: GZ8MTXP02JBQ3K.4.67.G01.1.454.CMB.2.raw
  modified_base (308)..(308): a, c, t, g, unknown or other
  modified_base (384)..(384): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccgggggggtccctgagactctcctgtgcagccctctggattcagttttagaatgtctgccatgacctgggtcccnccaggctccgtggggaggggctgggagtggatcgtcgaggggtattaggtggcacgtggcgtattatacatattanacagacctccggtagaacgggcccgcttccaccatcctcccaagacgaactaacttaccaaagaacacggtagtataccgtagacctaaagtacgaaacgacgccgtaggaacgaccggacggaacgaaccgaccggaccaaccaattacttaccgtagtacgaacgaaaagtcgttccggacgggtcggttcgggttcccggtccggggtaccggttagg

SEQ ID NO: 399305 - DNA, 537 bp, Homo sapiens
  misc_feature: GZ8MTXP02FQ4LX.4.67.G01.1.454.CMB.2.raw
  modified_base (306)..(306): a, c, t, g, unknown or other
  modified_base (372)..(372): a, c, t, g, unknown or other
  modified_base (395)..(395): a, c, t, g, unknown or other
  modified_base (435)..(435): a, c, t, g, unknown or other
  modified_base (455)..(455): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtctgggggaggcctgggcacgaggccgggggggtccctggagactctcctgtgcagccctctggattcagtttagaatgtctgccatgacctgggtccncaggctccgtggggaaggggctggagtggatctcgaggggattaggtggcacgtggcgattatacntattatacagactcgagaggccnttcacatctccagcgaacaaattccaaaagaacaacggtntaatctgacaaaatgaaacngacctgaagagaccgaggaccacggccaacacgtaattactgagacgaaagaatcgacgggctcggttccgcggtaccggta

SEQ ID NO: 399306 - DNA, 791 bp, Homo sapiens
  misc_feature: GZ8MTXP02F6MQ9.4.67.G01.1.454.CMB.2.raw
  modified_base (308)..(308): a, c, t, g, unknown or other
  modified_base (358)..(358): a, c, t, g, unknown or other
  modified_base (388)..(388): a, c, t, g, unknown or other
tcagagcactgtagcacgaccggtgctcgatttagagtatacatattgggtttggggtctgagagaggggcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggcccggggggtccctggagactctcctgtgcagcctctggattcagttttagaatgtctgccatgacctgggtcccnccaggctccgtggggaaggggctgggagtggatcgtcgaggggattaggnggccacgtgggactattatacattattaanacagtaccttccggtaggaaacggggtcccgtactttaccgaaccctattccctacccgaaagtacgaaccctaaaacgtttaccccgaaaacgggtaaacctaccggggttagttaaacctccgttacggaaacctaaaaacgttcgggaaaaaccacgggtacccccttaggggaaaccggtaaacggggacccccgggaaaaggggtaacccccggaaacccgggggacccccaaaaccgttaatttaaaccgttttaaaacccggtcgggtttaaccgggaaacccggttaaaaagggtaaccgtttaaccccgggtacccggggggtacctttttccgggggtttacccccgggggtcccgggggttaaccccgggggttaagtttttaaccgggggg

SEQ ID NO: 399307 - DNA, 666 bp, Homo sapiens
  misc_feature: GZ8MTXP02IRG9X.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtccctgagactctcctgtgcagcctctggattcagttttagaatgtctgccatgaccgtgggtcccgccaggcctccggtaggggaaggggctagggaggtggactctcgagggtattaggtcggcacgtggcgtattagacattaattatacgagtactcgtaggaacgggcccgtcttaccacctatcctaccgaagacgaactaacttacccgaaagaacgtacggttagtactacgtagactaaaagtacgaaaccagacctaggaacggaacgaccggaaacgggaacccgaaccgggacccaaactaaacttaacgttaaaccggtggttaaccggaacggtaaaaacggtgttaccggttaccggggtcccgtttcgggggtttccccggtaccgggggtttacccggggttaacggg

SEQ ID NO: 399308 - DNA, 695 bp, Homo sapiens
  misc_feature: GZ8MTXP02FOK5U.4.67.G01.1.454.CMB.2.raw
  modified_base (288)..(288): a, c, t, g, unknown or other
  modified_base (315)..(315): a, c, t, g, unknown or other
  modified_base (348)..(348): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggaggcctggcacgaggcccgggggggtccctggagactctcctgtgcagccctctggattctagttttanaatgtctgccatcgaccgtgggtcccnccaggcctccgtggggagggctggagtggatcncgaggggtattaggtcggcacgtgggcgtattatacattaattataacagaccttcggtaggaacgggccctcttcacctactcctcccaaggacgaactaacttacccaaaagaaccgtaaacgggttgtaaacttcccgttagaaccctaaaagttagaaaacccgtaagacccgttaaggaacggaccggaacccgggtaaacgggaaacccgaaccggggtaccccaaaccgtaaatttaaacgttaaaccgttggtaacggaaccggttaaaaagaacgttcccggtaccgggggtccgtttaccggggttaccccggtccggggtacccggggtttaaagg

SEQ ID NO: 399309 - DNA, 649 bp, Homo sapiens
  misc_feature: GZ8MTXP02F1E8G.4.67.G01.1.454.CMB.2.raw
  modified_base (266)..(266): a, c, t, g, unknown or other
  modified_base (318)..(318): a, c, t, g, unknown or other
  modified_base (356)..(356): a, c, t, g, unknown or other
tcagagcactgtagcacgaccggtgctcgatttagagtatacatattgggtttggggtctgagagaggagcccagccatgggattttcaggtgttttcatttggtgatcaggactgaacagagagaactcaccatggagtttgggctgagctggtctttttcttgtggctaattttaaaaggtgtccagtgtgaagtgcagctggtggagtcgtgggggagcctggcacgaggccggggggtcctgagactctcctgtgcagcctntggattcagtttagatgtctgccatcgaccgtgggtccgccaggcctccggnggggaaggggctgggagtggatcgtgagggtattaggngcacgtggacgtattatactattattaatacaagtaactccgggtaggaaacggggccctacttacccaacctagttccctacccgaagtaacgaacctaaacttacccgaaagaaaccgtacggttagtacttcgtagaaaccaaaatacgaaacgacgtacctaggaacgacggaccgaaggggacccaaccgggaccaaactaattaaacgttaccgtaggtacggaaaccgtaaaaggtacgttccgtcgggggtccgtttcggggttcccggccggggtttaacgggg

SEQ ID NO: 399310 - DNA, 584 bp, Homo sapiens
  misc_feature: GZ8MTXP02JTVRF.4.67.G01.1.454.CMB.2.raw
  modified_base (532)..(532): a, c, t, g, unknown or other
  modified_base (556)..(556): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctaattttaaaaggtgtccagtgtgaagtgcagctggtggagtcgtgggggaggcctggcacgaggccgggggggtccctggagctctcctgtgcagcctctggattcagttttagaatgtctgccatgacctgggtccgcctaggctccgtggggaggggctgggagtggatctgagggtattaggtggcagtggcgtattaatacattattaaactacagtacctccggtagaaacggggcccgccttaccaccacttcctacccaagacgaacaaacttcccgaaaagaaccgtaacggtgttaaactctagacaaataggaaacacgaccaggacgaggaccgaagacgaccggtaccanactaagttactacgagacgaaagntcgtcgggctcggtccgcgggtcggtag

SEQ ID NO: 399311 - DNA, 575 bp, Homo sapiens
  misc_feature: GZ8MTXP02GH2FY.4.67.G01.1.454.CMB.2.raw
  modified_base (311)..(311): a, c, t, g, unknown or other
  modified_base (380)..(380): a, c, t, g, unknown or other
  modified_base (414)..(414): a, c, t, g, unknown or other
  modified_base (544)..(544): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctgggtggagtcgtgggggaggcctggcacgagggccgggggggtccctgagactctcctgtgcagcctctggattctagtttagaatgtctgccatgacctgggtccnccaggctccgtggggaaggggctggagtggatcgtcgagggtattaggcggacacgtggacgtattaanaactattattataacagactcgtagaacgggccncttcaaccatctaccagacgaactaactaccaaaagaacgtacggtgtaactctagactaaaatcgaaacagccgtagaacgacgaccgaggaccaacggtccaatatacttacgtgacgaacgaaaagngtacgtcggtctggttccggcggtacggtag

SEQ ID NO: 399312 - DNA, 639 bp, Homo sapiens
  misc_feature: GZ8MTXP02GJ11Q.4.67.G01.1.454.CMB.2.raw
  modified_base (261)..(262): a, c, t, g, unknown or other
  modified_base (269)..(269): a, c, t, g, unknown or other
  modified_base (279)..(279): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctaattttaaaaggtgtccagtgtgaagtgcagctggtggagtcgtgggggagcctggcacgaggccggggggtcctgagctctcctgtgcnnctgtgtntcgtagttanagtcgtctcgcctagtcgtaccgtcgggtcccgccgacggtccgtccgggtaggggacggggtcgtagggtaggtacggtacgtcgtacggtagggtagttcggtccggacgtacgtcggtacttaattactaacttattaactaacgtacgaacgtaccgtacggtaacggaaccggtccctcctaccacctactaccgacgaagactaactaacgtaccgaaacgtacgtacggtagtactacgtagacgtaacgtaacgaacgacgacgtacgacgacgacgacgacgacgacactactacgtacgtacgtacgaacgacgtaacgtcgtcggtcgtcggtccggtcggtacggtcg

SEQ ID NO: 399313 - DNA, 579 bp, Homo sapiens
  misc_feature: GZ8MTXP02G9WQO.4.67.G01.1.454.CMB.2.raw
  modified_base (260)..(260): a, c, t, g, unknown or other
  modified_base (314)..(314): a, c, t, g, unknown or other
  modified_base (478)..(478): a, c, t, g, unknown or other
  modified_base (491)..(491): a, c, t, g, unknown or other
  modified_base (493)..(493): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttctgtggcttaattttaaaaggtgtccagtgtgaatgcagctggtggagtcgtgggggagcctggcacgacgggccggggggtcctggagctctcctgtncacgcctctggtattctagtttagaatcgtctcgccatcgaccgttgggccccncgacggtctccggtaggggaacggggtcgtgggaggtgggattccgtgaggggtattagcgggctacgtggacgtattataactattaattaatacagtaccgtacgtagaacgggtcctcttaccacactccacgagacaactaactaaccaatacgacggtntatctagataaananacacacagagacgacgacgacgacgacactactactactacgtacgacgaagtaacgcgtacgtcgtcggtcggtcggtacggtcg

SEQ ID NO: 399314 - DNA, 788 bp, Homo sapiens
  misc_feature: GZ8MTXP02IEJD0.4.67.G01.1.454.CMB.2.raw
  modified_base (224)..(224): a, c, t, g, unknown or other
  modified_base (243)..(243): a, c, t, g, unknown or other
  modified_base (260)..(260): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcgttttctagtggctattttaaaaggtgtccagtgtgaagtgcagctggtggagtcggaggggcgtcgngcacgcggggccggggtcngacgctctcgtgcgacncgcctgtgtattagttagttaagtagtcgtgtcgactagtaccgtccggttcggcccgcggcgtccgtccgggtagggggacggtggtaggtaggcgtactccgtaggtaggggttaagttgggtccgaaccgtcgggtacgggtacgttaactttaacgtaacttagtttaaagtttaactaaacgtaacgtacccgtttacgggaggggtaaacccgggccctttacttacccgaaactccttacccgaacgaaaggaacctaaaactttaacccgtaaaccgaaaaacggcccggttaacgggtttataaaccctggttaacccgaaaactttaagggaaacgtaaactaacccgtacgacggaaggaccggaaccgggaaacggaaccggaacccgggaaccgaacccgtaacgtttaacttaacgtttacggtaacggtaacggaaagtaaacggttaccgggttaccgggttccgggttaccgggttacccggggttacccggggtacccgggtttacgggg

SEQ ID NO: 399315 - DNA, 682 bp, Homo sapiens
  misc_feature: GZ8MTXP02IIS6D.4.67.G01.1.454.CMB.2.raw
  modified_base (259)..(259): a, c, t, g, unknown or other
  modified_base (519)..(519): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcttttctgtggctattttaaaaggtgtccagtgtgaagtgcagctggtggagtcgtgggggagcctggcacaggccgggggtacggtcgagacgtctctgtgcngctctgtagtctagttagtaatgtctgccactgaccgtcggtccggccgacggcgtcccgtcggggtaggggacggtggtaggtggtagtcgtcgtagggaggttagtggtacgacgtacggtaggatttaatacctattaatttaactaacgtaacgaccgtaccggttaggaaacggggtcccgtctacccttaaacccacgttacctccgaaggacgtaaacctaaacttaaccgaaacgacgtaacggttagttanacctagacaaagtacgtaacgacgtacgtagaacggacgaccgggtaaacggacccgtacgacctaactaaacttaacgttaacgtcggtaaacgaacgtaaaacgtcgtacccggttcgggtacccggttcgggtttacccggggtccggggtacggtaagg

SEQ ID NO: 399316 - DNA, 594 bp, Homo sapiens
  misc_feature: GZ8MTXP02FOLFR.4.67.G01.1.454.CMB.2.raw
  modified_base (308)..(308): a, c, t, g, unknown or other
  modified_base (469)..(469): a, c, t, g, unknown or other
  modified_base (494)..(494): a, c, t, g, unknown or other
  modified_base (533)..(533): a, c, t, g, unknown or other
  modified_base (557)..(557): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttcttgtggcttattttaaaaggtgtccagtgtgaagtgcagctggtggagtcgtgggggaggcctggcacgaggcccgggggggtcctggagactctcctgtgcagcctctggattcagttttagaatgtctgccatgacctgggtccnccgaggctccgtggggaagggctggagtggatctcgagggatttaggcggcacgtggacgtattactaactatattaatacagtactccggtaggaaacgggtcccgtcttaccacctatccctaccaagacgtacaaacttaccgaaagaactacgggtntatccgtagactaaaagtcgaaacngccgagaacgacgacccggaggaaccgaccggacctaanattaactacgtcgagacgaaaagngtcgtcggtcgtcgggttcccggacgggtccggtaag

SEQ ID NO: 399317 - DNA, 589 bp, Homo sapiens
  misc_feature: GZ8MTXP02IG5LJ.4.67.G01.1.454.CMB.2.raw
  modified_base (379)..(379): a, c, t, g, unknown or other
  modified_base (470)..(470): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttttcttgtggctattttaaaaggtgtccagtgtgaagtgcagctggtggagtcgtgggggaggcctggcacgaggccggggggtccctggagactctcctgtgcagcctctggattcagttttagaatgtctgccatgaccgtgggtcccgccaggctccgtggggaaggggctggagtggatcgtcgagggtattaggtcggcacgtggacgtatttanacattattaataacagtacctccggtggaaacgggcccgtctccaaccatccctccaagacgaacctaacttacccaaagaacacgggttntaatctagactaaatagaacgacgcctagaacgacgaccgaaggaccaccggaccacgaattactactgacgtacgaaagaactcggtacggcttcgggtcccggtcgggtacgggtag

SEQ ID NO: 399318 - DNA, 614 bp, Homo sapiens
  misc_feature: GZ8MTXP02HID6G.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtccctgagactctcctgtgcagcctctggattcagttttagaatgtctgccatcgaccgtcgggtcccgccgaggcctccggtaggggaacggggctgggaggtgggatcgtacgaggggtatttaggtcggacacgtggacgtattatacattattaatacagaccttccggaggacgggccctacttccaccatcctaccagacgactaacttaccaaagaactacggtagtactctagacaaagtagaaccagacctagaacggacgaccggaaggaccaaccgggaccaataacttagttaccgtggtacgaccgaaaagtcgtcggttaccggggcgttcgggtccccggtcggggttaccgggtaag

SEQ ID NO: 399319 - DNA, 744 bp, Homo sapiens
  misc_feature: GZ8MTXP02FOF0O.4.67.G01.1.454.CMB.2.raw
  modified_base (265)..(265): a, c, t, g, unknown or other
  modified_base (275)..(275): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctagtggctatttaaaaggtgtccagtgtgaagtgcagctggtggagtcgtgggggaggcctggcacgaggcccgggggggtccctggagactctcctgtgcncgcctgtgtnttctagtttagatgtctcgcagtcgaccgtcgggtccgcgcggccgtcggtggggagggtcgtgggaggtggagtcgtacgagggtagttaggtcggacgtacgtggactaattataactattaattaactaaccgtaacgtaccgttaccgggtacgggaaccgggtcccgttaccttacccgacctacgttacccgtaccgaaacggaaccgtaaactaaacgttaacccgaaaacggtaaccgtaacgggttacgtacttacgtaacgaaactaaaacgtaacgtaaaccgaacgaccgtacggaacggaacggaccgggaacgggaaccggaaccggacccgaaccgtaaacgttaacgttaacgttacggtacggtaacggtaaaacggtaacggttaccggtaccggggttaccgggtttaccggggtttacccggggttacccggggttaccggggttacgg

SEQ ID NO: 399320 - DNA, 660 bp, Homo sapiens
  misc_feature: GZ8MTXP02JORFK.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccggggggtcctgagactctcctgtgcacgcctcgtggtacttcgagttttagaatgtctgcctatcgacccgtgggtcccgccgacggtccgtccgtaggggaacggggcgtggggacggtggacttcgtacgaaggggtagttaggtcgggcctacgtggacgttattaactaactagtttattaataaccgaagtaccgttaccgggtaggaaccgggggtccctcgtttacccacctactcctacccgaggacaaacctaaacgttaccgaaaacgtaacgtacggttacggttaactcgttagaacctaaagtacgaaaacgcgtaccgagaaggaccgaccggaaggaaccacggaccactagtacttagcgtacgaccgaaatcgtcgtacggcgttacggtccggtacggtccggttagg

SEQ ID NO: 399321 - DNA, 606 bp, Homo sapiens
  misc_feature: GZ8MTXP02GSF6U.4.67.G01.1.454.CMB.2.raw
  modified_base (303)..(303): a, c, t, g, unknown or other
  modified_base (514)..(514): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggcttttctgtggctattttaaaaggtgtccagtgtgaagtgcagctggtggagtcgtgggggagcctggcacgaggccggggggtccctgagactctctgtgcagcctctggattcagttttagaatgtctgccatcgacctgggtccnccgaggcctcgtgggaagggctggagtggatcgtcgaggtattaggtcgctacgtggacgtattacgtacagttacttaataccgtagtacctcccggtaggaaacggggtccctactttaccgaacctatccctaccgaagacgaactaaacgttacccgaaaagaaccgtacgggttataaactccgtagaaccaaagttcgaaaaccncgtacgtagacgacgacgacgacacgacatactactacgtacgacgaacgtaagcgtcggtcgggtaccgtcgggtccgacgggtacggtag

SEQ ID NO: 399322 - DNA, 679 bp, Homo sapiens
  misc_feature: GZ8MTXP02FKDBG.4.67.G01.1.454.CMB.2.raw
  modified_base (318)..(318): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctgggtggagtcgtgggggaggcctggcacgagggcccgggggggtccctggagactctcctgtgcagccctcgtggattctagttttagaatgtctgccatcgaccgtgggtcccnccgaggctccgtggggaaggggctggagtggatctacgaggggtatttaggcggctacgtgggacgatttaatactagtattatacgagtacctccggtagaacgggcccgcttccacctactcctacccaaggacgtaacaaacttaccgaaaagtaaacgtaacgggtataacttctacgaacctaaaagtacgaaaaccacggtacccgtaagggaacgaacggacccgggaaacgggacccgtaaccggggaccctaaaccgtaaattaacgtttaaaccgtaggttacgaacgtaaaaaggtcgttaccggtcgggggtaccttcggggtttacccggcggggtaccggggttaag

SEQ ID NO: 399323 - DNA, 525 bp, Homo sapiens
  misc_feature: GZ8MTXP02IXNWN.4.67.G01.1.454.CMB.2.raw
  modified_base (304)..(304): a, c, t, g, unknown or other
  modified_base (435)..(435): a, c, t, g, unknown or other
  modified_base (440)..(440): a, c, t, g, unknown or other
  modified_base (453)..(453): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggagcctggcacgaggccggggggtcctggagactctcctgtgcagcctctggattcagtttagatgtctgccatcgacctgggtccncaggctccgtggggaggggctggagtggatcgtcgagggattaggcggcacgtggcgtattatacattattatacagtacctcgtaggaacggccgcttcacatctcagacgacaattacaagacacggtntactntgacaaatgaacngctgagagaccgagacacggcaacatatactgtcgacgaaagaatcgcggtcgtcggtccgcggtccggtag

SEQ ID NO: 399324 - DNA, 831 bp, Homo sapiens
  misc_feature: GZ8MTXP02F8A4F.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggagcctggcacgaggccggggggtccctgagactctcctgtgcagcctctggattcagttttagaatgtctgccatcgaccgtgggtcccgccgacggctccggtggggaaggggtctgggagtggattcgtcgaggggtattaggtcggctacgtggacgtaatttacgtaactattaattaataaccgagtacccgttacccggttagggaaacgggggtcccctacctttacccaacccgtacttacccgttaccccgaaggaaccgtaaacttaaaacgtttaccccgaaaaaggtaaacccgtaacggggtttacgttaaattaccccgttagggaaacctaaaaaggttacggaaaaacccgacgggtaccccgttaaggggaaaccggaaaccggacccccggggtaaaacggggaaaacccccgaaacccgggggtaacccccaaaaccttaaaggtttaaacctttaacccggttaacggttaaccgggtaaacccggtaaaaaaggtaacccggtttacccgggttacccggggggttacccgtttacccggggggttttacccccgggggaacccgggggtttccccgggggtttaaaacggg

SEQ ID NO: 399325 - DNA, 582 bp, Homo sapiens
  misc_feature: GZ8MTXP02JRIRV.4.67.G01.1.454.CMB.2.raw
  modified_base (377)..(377): a, c, t, g, unknown or other
  modified_base (458)..(458): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttcttgtggctaattttaaaaggtgtccagtgtgaagtgcagctggtggagtcgtgggggaggcctgggcacgaggccggggggtccctggagactctcctgtgcagcctctggattcagttttagaatgtctgccatgacctgggtccgcaggctccgtgggaaggggctgggagtggatcgtcgaggggtattagggcgacacgtggactattanactattatatacagtactcggagaacgggcctaccttcacctatcctacagacaactaaactaccgaaacgtaacgacgtntactctagacaagacgaacacgcaggacgacgaccgagaccgacggtaccaatactacttacgtacgtacgaacgaagtaacgtcggtccgggtacgttccgggtcccggacgggttacgggtg

SEQ ID NO: 399326 - DNA, 693 bp, Homo sapiens
  misc_feature: GZ8MTXP02F6YDA.4.67.G01.1.454.CMB.2.raw
  modified_base (497)..(497): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggagcctggcacgaggccggggggtcctgagactctcctgtgcagcctctggattctagtttagatgtctgccatcgtaccgtcgggtccgccgaggcctccggtggggaacggggctgggagtggatcgtacgagggtattaggtcggctacgtggacgtaattataacgtattacgttaataacgacgtaccgtaccggtagggaaccggggcccgtcttaccgaccactcctaccgagacgtaactaaacttacccgaaaagaaccgtaacgggttntaactacgtgaaacctaaaagtacgaaactacggtaccctaggaaacggaccgacccgggaagggaacccacccggggaccctaaataaacgttaacgtttaaaccgtaggtaacggaaaccggtaaaaaggtcgtttaccgggtccgggtaccggtttccggggtcccggggtaccggggttacccgggttaagg

SEQ ID NO: 399327 - DNA, 745 bp, Homo sapiens
  misc_feature: GZ8MTXP02FOGKZ.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgacggccgggggggtccctgagactctcctgtgcagcctctggattctagttttagaatgtctgccatgaccgtgggtcccgccaggcctccgtggggaaggggctgggagtggatcgtacgagggtatttaggtcggccagtgggcgtaatttactactattatttaactaacaagtaccttccggtaggaaacggggcccgtcttaccgaccctattcctacccgaagaacgtaacaaaacgtttaccaaaagtaaaccgtacgggttagtaaacttctacggaacctaaaaagtaggaaaacccacggtacccttagggttaacggaacggtaccccggaaacggggaaaccccgtaacccggggaccctaaaaccgtaaacttaaacgtttaacccgttaacggtacggaaccggtaaaaaacgggtcgtttaaacccggtaccgggggttccccgtttaacgggggtttacccccggggtccgggggttaccccgggggtttaaacggg

SEQ ID NO: 399328 - DNA, 554 bp, Homo sapiens
  misc_feature: GZ8MTXP02IGLS8.4.67.G01.1.454.CMB.2.raw
  modified_base (187)..(187): a, c, t, g, unknown or other
  modified_base (204)..(204): a, c, t, g, unknown or other
  modified_base (211)..(211): a, c, t, g, unknown or other
  modified_base (219)..(219): a, c, t, g, unknown or other
  modified_base (223)..(223): a, c, t, g, unknown or other
  modified_base (253)..(253): a, c, t, g, unknown or other
  modified_base (256)..(256): a, c, t, g, unknown or other
  modified_base (268)..(268): a, c, t, g, unknown or other
  modified_base (284)..(284): a, c, t, g, unknown or other
  modified_base (286)..(286): a, c, t, g, unknown or other
  modified_base (315)..(315): a, c, t, g, unknown or other
  modified_base (321)..(321): a, c, t, g, unknown or other
  modified_base (330)..(330): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcggtgtcgtttctaggtcggctaattttaaaagggtntcagtgtgaagtgcagngtggtgngtgtgggngcgngcgacgcggccggggtcgtgagctctctgngcnctctgtgtattntagttagtatgtctcncncgtcgtccgtcggtccgcgcgtcgtcggnggaggngtggtgtgngtgtgtagtagtgtcgcgtgtgtagtatatatatatatacgtacgtacgtcgtacgtacgccgtctactactactctacgagaactaactaactaactaacgtaacgtacgtagtactactagtataagtacgacgagacgagacgacgacgacgacgacgactactagtatacgtacgtacgacgagtaacgtcggtcggtcgtcggtcggtcggtacggtcg

SEQ ID NO: 399329 - DNA, 598 bp, Homo sapiens
  misc_feature: GZ8MTXP02FY04K.4.67.G01.1.454.CMB.2.raw
  modified_base (304)..(304): a, c, t, g, unknown or other
  modified_base (467)..(467): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtcgtgggggaggcctggcacgaggccggggggtccctgagactctcctgtgcagcctctggattctagttttagaatgtctgccatgacctggtccncgaggctccgtggggaagggctggagtggatcgtcgagggtattaggtggcacgtggcgtattatacattattaatacgagactccggtagaacgggccgtcttaccacctatcctacccgaagacgaacctaaacttaccgaaaagtaacgtaaccgggttntaacttacgtagaacctaaaagtagaaaccagaccgtagaacgacgaccgaaggaccacggaccaacgtataacttacgtgtacgacgtaaaagcgttcgtcgggccgttcggtccggcgggttcggtaag

SEQ ID NO: 399330 - DNA, 544 bp, Homo sapiens
  misc_feature: GZ8MTXP02J1DDS.4.67.G01.1.454.CMB.2.raw
  modified_base (311)..(311): a, c, t, g, unknown or other
  modified_base (380)..(380): a, c, t, g, unknown or other
  modified_base (411)..(411): a, c, t, g, unknown or other
  modified_base (450)..(450): a, c, t, g, unknown or other
  modified_base (455)..(455): a, c, t, g, unknown or other
  modified_base (471)..(471): a, c, t, g, unknown or other
  modified_base (491)..(491): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttcttaggtggctattttaaaaggtgtccagtgtgaagtgcagctggtggagtcgtgggggaggcctggcacgaggccgggggggtccctgagactctcctgtgcagcctctggattcagttttagaatgtctgccatgacctgggtcccnccaggctccgtggggaagggctggagtggatctcgaggggtattaggtcggcacgtggcgtattatacntattatacagactccgtagaacggggccctnttccaccatccctccagagacaattccaagacacgggtntatcngacaaatgaacagccngagagccgagacacggccanactatacgtgacgacgaaaagcgtcgtcgggcttggtcccggcggtccggtag

SEQ ID NO: 399331 - DNA, 654 bp, Homo sapiens
  misc_feature: GZ8MTXP02J2YW2.4.67.G01.1.454.CMB.2.raw
  modified_base (526)..(526): a, c, t, g, unknown or other
  modified_base (548)..(548): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttcttgtggctaattttaaaggtgtccagtgtgaagtgcagcgtggtggagtcgtgggggagccgtggcacgacggccggggggtccctgacgacctctcctgtgcacgcctcgtggattctagttttagattcgtctcgctagtcgaccgtcgggtccccgccgaggtccgtaccggtaggggaacggggtcgtaggggaggtggaacttccgtagtagggtacttaggcggacacgtggacgtattacgtactatataactacagtaccgtcggtacggaaccgggtccctaccgttacaacccgtactacccgtaccaaggaaccaaactaacgttaaccgaaacgtaaccgtacgggttatacncgttagaactaaagacgaaccncggtacaggaacgaccggacgacggactaccggctaaagcttaactcgtacgacgaacgtaaacgtcgtcggccggtcggttaccggtccggtacgggtccggtag

SEQ ID NO: 399332 - DNA, 646 bp, Homo sapiens
  misc_feature: GZ8MTXP02HRIVU.4.67.G01.1.454.CMB.2.raw
  modified_base (399)..(399): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttctgtggctattttaaaaggtgtccagtgtgaagtgcagctggtggagtcgtgggggagcctggcacgaggccgggggtccctgagactctcctgtgcagcctctggattctagttttagaactgtctgccatgacctcgggtccgccgaggcgtccgtaggggaagggcgtggagtggatcgtcgagggtagttagtcggactacgtcgggagtaattacgtaactattaatttaanaacctacgtacgttacccggttaggaaacggggtccccgtcttaccgaccctatcctacccaagacggaacctaaagttcccaaaggaaacctcgggtattataacccgtgaaaccaaaagtcggaaaccgcgaccgtagaacgccggtaaccgacgggaacctaccggacctaataacttacgttacgacggacgaacgaagtcgtacggtcgggtcggttacggtcccggtacgggttacggtag

SEQ ID NO: 399333 - DNA, 634 bp, Homo sapiens
  misc_feature: GZ8MTXP02GZ7WE.4.67.G01.1.454.CMB.2.raw
  modified_base (311)..(311): a, c, t, g, unknown or other
  modified_base (506)..(506): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttctgtggctaattttaaaaggtgtccagtgtgaagtgcagctggtggagtcgtgggggaggcctggcacgaggccggggggtccctgagactctcctgtgcagcctctggtattcagttttagaatgtctgccatcgaccgtgggtcccncgaggctccgtaggggaacgggcgtggaggtggatccgtagaggggtattaggtcgggactacgtggacgtattataactattaattaactaccgaagtaccgttaccggtagggaaacggggtccctctttacccaacccatccctcccgaagaacgaactaacttacccaaagaaccgtacggtatatcgtanaactaaagtacgaacgtacgacgtaggaacgacgaccggacggaccgaccgacctaactaacttaacgtacgtacgtacgaacgtaagtcgtcggtcggtcgttcgggtccggtacgggtacggtacg

SEQ ID NO: 399334 - DNA, 595 bp, Homo sapiens
  misc_feature: GZ8MTXP02GU3SD.4.67.G01.1.454.CMB.2.raw
  modified_base (308)..(308): a, c, t, g, unknown or other
  modified_base (463)..(463): a, c, t, g, unknown or other
  modified_base (487)..(487): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtccctgagactctcctgtgcagcctctggattctagttttagaatgtctgccatgaccgtgggtccncaggctccgtggggaagggctggagtggatcgtcgaggggtattaggcggcacgtggacgtattactacgtattattatacagtacctccggtagaacggggccctcttaccacctagtcctaccagacgactaattacccaaagaactacggtntaactcgtagacaaagtcgaaacncgacgaggacgacggacgaacgaccgtacggacaactacttacgttacgtacgtacgaacgaaagtcgtcggtacgggtcgttcgggtcccggtcggggtacggtacg

SEQ ID NO: 399335 - DNA, 561 bp, Homo sapiens
  misc_feature: GZ8MTXP02HLA67.4.67.G01.1.454.CMB.2.raw
  modified_base (269)..(269): a, c, t, g, unknown or other
  modified_base (310)..(310): a, c, t, g, unknown or other
  modified_base (415)..(415): a, c, t, g, unknown or other
  modified_base (447)..(447): a, c, t, g, unknown or other
  modified_base (459)..(459): a, c, t, g, unknown or other
  modified_base (462)..(462): a, c, t, g, unknown or other
  modified_base (465)..(465): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttcttaggtggctaattttaaaaggtgtccagtgtgaagtgcagctggtggagtcgtgggggagcctggcacgaggccggggggtcctgagactctcctgtgcagccctntggtatctagttttagaatgtctgccatcgaccgtggcccncgaggcctcgtggggaagggctggagtggatcgtagagggtataggcggcagtgacgtattacatataattacacagacttccgagacgggcctcttacactacnctaccagacactaactaccaaagaacacggtntaactcagaaanaanaanaacacgacgagacgacgacgacgacgacgacactactactactacgtacgaacgaagaacgtcgtcggtcggtccggtccggtccggtacggtacg

SEQ ID NO: 399336 - DNA, 682 bp, Homo sapiens
  misc_feature: GZ8MTXP02ISVBW.4.67.G01.1.454.CMB.2.raw
  modified_base (316)..(316): a, c, t, g, unknown or other
  modified_base (351)..(351): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctaattttaaaaggtgtccagtgtgaagtgcagctgggtggagtcgtgggggaggcctggcacgacgggccgggggggtccctggagactctcctgtgcacgcctctggattcagttttagaatgtctgccatcgaccgtgggtcccnccgaggcctccgtaggggagggctggagtggatcncgagggattaggcggcacgtggacgtaattaatactattaattaatacgagtaccgtaccggtaggaaacgggcccgtacttaccaaaccctactcctacccgaagaacgaaactaaacttacccgaaaacgaaacgtaaccggtagttaactcgttagaaccaaagtacgaaaacgacgaccgtagagaacggacccggaaaggaaccgaaccgggacccaaagtaaacttaaacgtttaaccgtcgtaacggtaaaccgaaaaaggtcgttaccggtcgggtaccggttacggggttccccggtccgggggtttacccgggttaacggg

SEQ ID NO: 399337 - DNA, 638 bp, Homo sapiens
  misc_feature: GZ8MTXP02G8JVI.4.67.G01.1.454.CMB.2.raw
  modified_base (385)..(385): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccgggggggtccctggagactctcctgtgcagcctctggattcagttttagaatgtctgccatcgaccgtgggtccgccgaggcctccgtggggaagggcgtggaggtggatcgtacgagggtattaggtcggctacgtgggacgtattaanactataattactaacagacctcggtaggaacggggtcccacttaccgacctactcctccgaagacgaactaaacttaccgaaagtaaccgacggttagtactccgtagaacctaaagtacgaaccgagtaccgtagaacggacggaccggaaacgggacccaacgggacccaacgtacttaagtaccgtgtacgaaccgaaaagcgttacggtcggggtacgttccgggtccggtaccggggtaccggtaagg

SEQ ID NO: 399338 - DNA, 713 bp, Homo sapiens
  misc_feature: GZ8MTXP02I6PKE.4.67.G01.1.454.CMB.2.raw
  modified_base (371)..(371): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccggggggtcctgagactctcctgtgcagcctctggattcagttttagatgtctgccatgacctgggtccgccaggctccgtggggaagggctgggagtggatctcgaggtattagcggcacgtggacgtattagtacngttacttataacagtaccttccggtagggaaacggggtcccgtactttacccgaacctatcccgttacccgaagaaccggaaactaaacgttacccgaaaaacggtaacctaaccgggggttataaccttacgtacggaaaccctaaaagttacggaaacacggtaccctaggaaacggacggacccgggaaagggtaacccaaaccggggacccaaacggtactttaaacgtttaacccgttaggttaacggaacggtaaaaaacgtcgttacccggggttaccggggtaccggttcggggtttaccccgggaccgggggtttacccgggggtttaaacgg

SEQ ID NO: 399339 - DNA, 647 bp, Homo sapiens
  misc_feature: GZ8MTXP02FXECJ.4.67.G01.1.454.CMB.2.raw
  modified_base (301)..(301): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttctgtggctattttaaaaggtgtccagtgtgaagtgcagctggtggagtcgtgggggagcctggcacaggccggggggtccctgagactctcctgtgcagcctctggattcagtttagatgtctgccatgacctgggtcccncaggctccgtggggaaggggctggacgtggatcgtcgagggtattaggtggcacgtggcgtattagtactagtataatacagaccttccggtaggaacgggtccgccttccacctatctcccgaagacgaacaaacgttacccaaaacgtaaccgaacggttagtacttacgtacgaactaaaacgttacgaaaacacggacccgttaggaaacggacggaccggaacgggaacccgaaccgggacccaacgttaacctaaatttacgtacggttacgacgtaaaaacgcgttaccgtacgggggtaccgttcggggttcccgggccggggttaccggggttaacg

SEQ ID NO: 399340 - DNA, 602 bp, Homo sapiens
  misc_feature: GZ8MTXP02JMDS3.4.67.G01.1.454.CMB.2.raw
  modified_base (310)..(310): a, c, t, g, unknown or other
  modified_base (354)..(354): a, c, t, g, unknown or other
  modified_base (372)..(372): a, c, t, g, unknown or other
  modified_base (376)..(376): a, c, t, g, unknown or other
  modified_base (404)..(404): a, c, t, g, unknown or other
  modified_base (446)..(446): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggaggcctggcacgaggccgggggggtccctgacgactctcctgtgcagcctctggattcagttttagaatgtctgccatgacctgggtcccncgaggctccgtggggagggctggagtggatctcgagggattagnggcacgtggacgtattanactntattatacagactccgtagaacgggccnttccacatctaccagacgactaacttaccaaagaacacggtntaactcgtagacaaagtgaaacagccgtagacgacgaccggtaacgaccgacggacccaagtacttaacttaccgtggtacggaccgtaaaaaggtcgttacccggtacgggggtcctttggggttcccccggtacgggggttacccgggttaagg

SEQ ID NO: 399341 - DNA, 675 bp, Homo sapiens
  misc_feature: GZ8MTXP02II9WK.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggctttttctgtggctattttaaaaggtgtccagtgtgaagtgcagctggtggagtcgtgggggaggccgtggcacgaggccggggggtccctgagactctcctgtgcagccctctggtattctagttttaagaatgtctgccatcgaccgtggtccgcaggctccgtaggggaggggtctggagtggatcgtcgaggggtattagtcggcacgtggacgtaattactactattattaactaacgacgtaccgtaccggtaggaaacggggtccctctttacccaaccctatccctacccgaagaacgtaaactaaactttacccaaaaggtaacccacgggttacgtaaacttccgttaggaaaccctaaagtacggaaacctacggaccctaggaaacggacgtaccgggaacggaacctaccgggacccaacgaatttaacgttacgtagtacggtaaccgaaaaagtcgttccggtacgggttcttacggggttcccggtaacggggtcccgggtaag

SEQ ID NO: 399342 - DNA, 728 bp, Homo sapiens
  misc_feature: GZ8MTXP02IJG48.4.67.G01.1.454.CMB.2.raw
  modified_base (285)..(285): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggaggcctggcacgaggccggggggtccctgagactctcctgtgcacgcctctggtattcagttttanaatgtctgccatgaccgtgggtcccgccgaggcctccggtgggaaggggctggagtggatcgtcgagggtattagtcggctacggtggacgtatttataactattaatttaacactaacgtaccgttccgggtaggaaaccgggggccctacttacccaaccctagttcccgtacccaaggaaacgaacctaaacgttaacccgaaacgaaaccgtaccgggttagttaactaccgttaagaacctaaaagtacgaaaacgtacgacccgtaagacggaacggacccgggaaaacggaacccgtaaccgggaacccgtaaactaaactttaaacgtttaacccgtaggggttacgtaaaccggaaaagtaacgtttcccgggtaccggggtccggttaccggggtttccccggggaccgggggtttaacccggggtttaacgg

SEQ ID NO: 399343 - DNA, 635 bp, Homo sapiens
  misc_feature: GZ8MTXP02G9KOX.4.67.G01.1.454.CMB.2.raw
  modified_base (314)..(314): a, c, t, g, unknown or other
  modified_base (399)..(399): a, c, t, g, unknown or other
  modified_base (412)..(412): a, c, t, g, unknown or other
  modified_base (427)..(427): a, c, t, g, unknown or other
  modified_base (447)..(447): a, c, t, g, unknown or other
  modified_base (485)..(485): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttttcttgtggcttaattttaaaaggtgtccagtgtgaagtgcagctggtggagtcgtgggggagcctggcacgaggccggggggtcctgacgactctcctgtgcacgctctggtatctagtttagaatgtctgcctagtcgaccgtcgggtcccncgacggtcctaccgtgggtaacggggcgtagggaggtggtactcgtcgaggggtagtttacggcggactacgtggacgtaattanacgtattattaanacgtagaccttcggngaaacgggcctctaccgacncttccaccagacgactaactaccgaaagacctagggtntactcgtacgactaaaagtcgaaacacgcgtagaacggacgaccggaggacctaaccggaccaaacctagttaactaacgtcggtaacgacgaaaaggtcgtccgtacggggtaccgttccgggtaccggtcggggtacccggtttaagg

SEQ ID NO: 399344 - DNA, 741 bp, Homo sapiens
  misc_feature: GZ8MTXP02JES0I.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctgggcacgacgggcccggggggtccctggacgactctcctgtcgcacgcctctggattcgtagttttagaatgtctgccatcgacccgtggggtcccgccgaggcctcccggtaggggaacggggcgtgggaggtggactcgtacgaaggggtattaggtcggactacgtgggacgtatttaactaacgattaagttaaactaacgaacgtaccgttccggtaacgggaaacgggggccccttcttacccgaaccctacttaccctacccgaaagaacgaaacctaacttacccgaaaagaaccgtaacggggtacttacgtacctagaacctaaaagtacgaaaacgacgtacccgaggaaacggaacggacccggaaagggaacccgtaacccgggaccctaaacgtaacgtttaaacgttaaccgtacgtaaacggaaccggtaaaaagaacgttcccggtaccggggtacgtttcgggggttccccggtaccgggggttaccggttaacggg

SEQ ID NO: 399345 - DNA, 630 bp, Homo sapiens
  misc_feature: GZ8MTXP02JRM7W.4.67.G01.1.454.CMB.2.raw
  modified_base (312)..(312): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggcttattttaaaaggtgtccagtgtgaagtgcagctggtggagtcgtgggggaggcctggcacgaggccggggggtcctgagactctcctgtgcagcctcgtggattcgtagtttagaatgtctgccatcgaccgtggggtacccnccgaggccgtccggtggggaaggggtcgtgggaggtggactcgtacgaggggtacttaggtcggctacggtggacgtattaactacgtattaattaataacgagtaccttccgggtaggtaaacggggccctctttaccgacctagtcctacccaagacgtaactaacttaccgaaagtaaccgtacggtagttactcgtagaacaaagtacgaaacgacgtccgagaacgaggaccggacgaaccgacgggaccagacgttacctacgtgacgacgaaaagtgtcggtacggacgttcggtaccggcggtacggtag

SEQ ID NO: 399346 - DNA, 616 bp, Homo sapiens
  misc_feature: GZ8MTXP02HQ9C5.4.67.G01.1.454.CMB.2.raw
  modified_base (484)..(484): a, c, t, g, unknown or other
  modified_base (538)..(538): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggtctattttaaaaggtgtccagtgtgaagtgcagctgggtggagtcgtgggggaggccgtggcacgacgggcccggggggtcctggagactctccgtgtcgcacgcctcgtggtattctagttttagaatgtctgccagtcgaccgtgggtcccgcgcggccgtccggaggggagggcgtagggaggttggatcgtacgtagggtagttaggtcggacacgtggacgtattactatattatttaacactacgtacctcggtagacggggccctcttacacctatctaccagactaacaataccgaaagacacggttntactcgtagaacaaggtacaacgcgtcgagacgacgcggaagccgaccgactanatttacgttacgagtaccggaaagaagtcgtccgggtacgggtcgtacggtttcccggggaacggtttccgggttaag

SEQ ID NO: 399347 - DNA, 629 bp, Homo sapiens
  misc_feature: GZ8MTXP02HEL1C.4.67.G01.1.454.CMB.2.raw
  modified_base (311)..(311): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttcttgtggcttaattttaaaaggtgtccagtgtgaagtgcagctggtggagtcgtgggggaggcctggcacgaggccggggggtccctgagactctcctgtgcagcctctggattcagttttagaatgtctgccatgaccgtgggtcccncgacggctccgtggggaacggggctggagtgggatcgtacgaggggtatttaggcggcacgtgggacgtattatactattatttaagtacagtaccgttacgtaggaaacgggggccctacttacccacctaagttcccttacccgaaggaccaaactaaacttaacccaaagaaacgtaccgggttagtactcgtagacaaagtcgaaacagcctaggacgacgaccgaagggaccaacggacccaagtattaacttcgagtacgaacgtaaaagtcgtaccgtcggggcttcgggttcccggacgggtccggttag

SEQ ID NO: 399348 - DNA, 645 bp, Homo sapiens
  misc_feature: GZ8MTXP02HNXNW.4.67.G01.1.454.CMB.2.raw
  modified_base (316)..(316): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttcttgtggcttaattttaaaaggtgtccagtgtgaagtgcagctggtggagtcgtgggggaggcctggcacgaggcccgggggggtccctggacgactctcctgtgcagcctctggattcagttttagattgtctgccatgacccgtgggtcccncgaggcctccggtaggggaacggggtctgggagttgggattcgtagaggggtattagggtcggaccacgttcgggactaatttaactactattaaattaatacgacgtacctcggtaggaacggggcccgtacttacccaactctcctacccgaggaactaactaacgtttacccaaaagaacgtaccgggttagttaacttaccgttaaggaaccttaaaaagtaacgaaacgaacgacgtacgacggacggaccgacgacgacgacactactactacgtacgacgacgaacgaacgtcgtcggtcgtcggtccggtcggtacggtcg

SEQ ID NO: 399349 - DNA, 605 bp, Homo sapiens
  misc_feature: GZ8MTXP02HORPS.4.67.G01.1.454.CMB.2.raw
  modified_base (304)..(304): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggagcctggcacgaggccggggggtccctgagactctcctgtgcagcctctggattctagtttagaatgtctgccatgaccgtggtccncgaggctcgagggagggcgtggagtggatcgtcgagggtattaggtgcagtggacgtattatacattattatacagtacctcggtaggaacgggcctcttaccacctatcctaccgagacgaactaaacgttaccaaaagacctaaggttgttaatcgtagaactaaagtacgaaacgagtcgttaaggagacggaccggaaaggaccgaccggaccaaactagtaacttacgtacgacgaacgtaaacgaacgttccggtacggtcggttcgggttcccggcggggttaccggtttacgg

SEQ ID NO: 399350 - DNA, 684 bp, Homo sapiens
  misc_feature: GZ8MTXP02F7WYV.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgacggccgggggggtccctgagactctcctgtgcagccctctggattctagtttagaatggtctgccatcgacctgggtcccgccaggctccgtggggaagggcgtggagtggatcgtgagggattgcggccagtggctattataacattattaactaacgagtaccttccgggtaggaaacggggtccctacgtttaccaaccctatccgtacccaaagacgtaactaaacttccaaaagtaacacgggtataactcgtagacaaaagtgaaaccgagtcccgtaggaaagaccggacccggaagggaaccccgaaccgggacccaaaactaactttaaacgtttaacccgtggtaaccggaaaccggtaaaaaggtccgtttccccgggtaaccgggggtccgtttaccgggggttccccggggtcccgggggttaacccgggggtttaag

SEQ ID NO: 399351 - DNA, 657 bp, Homo sapiens
  misc_feature: GZ8MTXP02J0H45.4.67.G01.1.454.CMB.2.raw
  modified_base (316)..(316): a, c, t, g, unknown or other
  modified_base (398)..(398): a, c, t, g, unknown or other
  modified_base (482)..(482): a, c, t, g, unknown or other
  modified_base (510)..(510): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcttttcttggtggcttaattttaaaaggtgtccagtgtgaagtgcagctggtggagtcgtgggggaggcctggcacgacggccgggggggtccctgagactctcctgtgcagcctcgtggattctagttttagatgtctgcctatcgaccgtgggtcccnccgaggcctccgtggggaacggggcgtgggagtggatcgtcgagggtataggtcggcacgtggcgtattagtacatattaanacagtacctcgtaggaacgggccctcttcaaccctactcctacccgaagacgaactaaacttacccgaaagaaacctacgggtntactacgtgaaccgtaaatacgaaaccncggtaccctagggaaacggcgacccggaagggaacccgacccgggacctaaaccaagtttaaccgttacgttcggggtacaaacggaaacgtaacgttccggtacggggtcgtttaccgggtcccggtccggggtaccggggttacg

SEQ ID NO: 399352 - DNA, 556 bp, Homo sapiens
  misc_feature: GZ8MTXP02JUBUN.4.67.G01.1.454.CMB.2.raw
  modified_base (308)..(308): a, c, t, g, unknown or other
  modified_base (375)..(375): a, c, t, g, unknown or other
  modified_base (413)..(413): a, c, t, g, unknown or other
  modified_base (429)..(429): a, c, t, g, unknown or other
  modified_base (449)..(449): a, c, t, g, unknown or other
  modified_base (477)..(477): a, c, t, g, unknown or other
  modified_base (495)..(495): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctaattttaaaaggtgtccagtgtgaagtgcagctggtggagtcgtgggggagcctggcacgaggccggggggtccctgagactctcctgtgcagccctctggattcagttttaagaatgtctgccatgacctgggtccnccgaggctccgtggggaagggctgggagtggatctcgaaggggtatttaggcggcagtggctattanaacattaattaataccagacctccgtagaaacgggccnttccacatcaccaganacaataccaaagaacacgtntatctagacaaatgaacagctagagacncgaagacacggacctaanaatactacgtagtacgaacgaaagtcgtcggtcggtcgttcggtccggaccgggtacggta

SEQ ID NO: 399353 - DNA, 638 bp, Homo sapiens
  misc_feature: GZ8MTXP02H7MOR.4.67.G01.1.454.CMB.2.raw
  modified_base (403)..(403): a, c, t, g, unknown or other
  modified_base (418)..(418): a, c, t, g, unknown or other
  modified_base (489)..(489): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtcctgagactctcctgtgcacgtcctctggtattcagttttagaatgtctcgccatcgaccgtgggtccccgccgaggcctccgtagggggaacggggtcgtgggagtggatcgtcgaggggtattaggtcggctacgtggacgtattagactattattaanacagacctccggtanaacgggccctcttaccacctattccacccgaagtaacgaaactaacttaccgaaagtaaacgaccgggttntaaacgtcgtaagacctaaaagtacgaaaccgacgccgtaggaggaaccggaccgaacggaacccgaaccggacactaattacgttacgtagacgaaccgaaagtctaccggtcgggtcttcgggttacccggcggggttaccggtagg

SEQ ID NO: 399354 - DNA, 650 bp, Homo sapiens
  misc_feature: GZ8MTXP02JKNL3.4.67.G01.1.454.CMB.2.raw
  modified_base (313)..(313): a, c, t, g, unknown or other
  modified_base (379)..(379): a, c, t, g, unknown or other
  modified_base (483)..(483): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctgggcacgaggcccgggggggtccctggagactctcctgtgcagccctctggattcagttttagaatgtctgccatgaccgtgggtcccnccaggctccgtggggaaggggctgggagtggatcgcgaggtattaggcgcacgtggacgtattaanactattattaataacagaccttccggtaggaaaccggggccctcttaccacctacttccctccgaagaccgaactaaacttacccgaaaagaccgtacgggttntaacttcgtacgaactaaaagtacgaaacacggaccctaggaaacggaccggaccggaacggaacccgacccgggacccaaagtaaatttaacgttaccgtaggtacgaacgtaaaagtgtccggtcggggtcgtaccggggtttcccggccggggttcggttaagg

SEQ ID NO: 399355 - DNA, 567 bp, Homo sapiens
  misc_feature: GZ8MTXP02HGNV6.4.67.G01.1.454.CMB.2.raw
  modified_base (230)..(230): a, c, t, g, unknown or other
  modified_base (259)..(259): a, c, t, g, unknown or other
  modified_base (269)..(269): a, c, t, g, unknown or other
  modified_base (271)..(271): a, c, t, g, unknown or other
  modified_base (359)..(359): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctaattttaaaaggtgtccagtgtgaagtgcagctggtggagtgtgggggagcctggcacgnggccggggggtcctgagctctcctgtgcncgctcgtgtntntagttagtatgtctcgcacgtcgtcgtcggtccgcgacgtcgtcgaggaggcgtggtagtgtgtcgtgaggtagtagtcgcgacgtgngtatatatatatatacacgtacgtacgtacgacgcgtctacactactctacacgacgaactaactaacaaacgaacgtaacgtacgtactacgtacgtaacaactacgaacgacgacgacgacgacgacgacgacgacgacactactactacgtacgtacgaacgaacgtaacgtcgtacggtcggtcggtccggtcggtacggtacg

SEQ ID NO: 399356 - DNA, 594 bp, Homo sapiens
  misc_feature: GZ8MTXP02IMSKB.4.67.G01.1.454.CMB.2.raw
  modified_base (327)..(327): a, c, t, g, unknown or other
  modified_base (395)..(395): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctaattttaaaaggtgtccagtgtgaagtgcagctggtggagtcgtgggggaggcctggcacgaggccgggggggtccctgagactctcctgtgcagccctctggattcagttttagaatgtcctgcccatcgacccgtgggtcccgccgaggctccgnggggaacggggctgggagtggactcgtcgaggggtacttaggtcgggccacgtcgggtacgtatttanacattataactaacagtacctcggtaggaacgggccctcttaccacctatccctacacgagaacaacttaccaagaactacggtgtaatccgtagacctaaagtacgaaccagcctaggacgagaccgaggaccacgaccagactaaacttcgagtacgacgaaagcgtccgtacggcttcgggtaccgcggtcggtag

SEQ ID NO: 399357 - DNA, 593 bp, Homo sapiens
  misc_feature: GZ8MTXP02IV843.4.67.G01.1.454.CMB.2.raw
  modified_base (375)..(375): a, c, t, g, unknown or other
  modified_base (518)..(518): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttctgtggctattttaaaaggtgtccagtgtgaagtgcagctgggtggagtcgtgggggaggcctggcacgagggccgggggggtccctggagactcctcctgtgcacgcctctggattctagttttagaatgtctgcctatcgaccgtgggtcccgccaggctcccgtggggaagggtcgtggaggtggatcgtcgagggtataggtggcagtggngtaattatacattattataacgagtacctcggtagaacgggcccgcttccaccatcctacgagacgaactaacttaccaaagacacggtagtaatctagacaatagaaacgtgacctgaagcgacgaggacaccggcaacgtntaacgtagtacgagaacgaaagtaacgtccggtacgggtacgttacggtaccccggtacgggtacccggttaagg

SEQ ID NO: 399358 - DNA, 558 bp, Homo sapiens
  misc_feature: GZ8MTXP02FTUPP.4.67.G01.1.454.CMB.2.raw
  modified_base (309)..(309): a, c, t, g, unknown or other
  modified_base (339)..(339): a, c, t, g, unknown or other
  modified_base (398)..(398): a, c, t, g, unknown or other
  modified_base (440)..(440): a, c, t, g, unknown or other
  modified_base (459)..(459): a, c, t, g, unknown or other
  modified_base (464)..(464): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggagcctggcacgaggccggggggtccctgagactctcctgtgcagccctctggattctagttttagaatgtctgccatgaccgtgggtccncaggctccgtgggagggctggagtggatcncgagggtattagcggcacgtggcgtattatacattatatacagtactcgagacgggccncttcaccatctaccagacgacaacttccaaagactacgggtntaactctagactaaaagtnaaacngcctagacgcgaccgaggacacggaccatattactacgtgtacgacgtaaaagcgtcggtacgggtcttcgggtacccggcgggttaccggtag

SEQ ID NO: 399359 - DNA, 719 bp, Homo sapiens
  misc_feature: GZ8MTXP02IJ77C.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttttcttgtggtctattttaaaaggtgtccagtgtgaagtgcagcgtggtggagtcgtgggggaggcctggcacgaggccggagggggtccctgagactctcctgtgcagcctctggattctagttttagatgtctgccagtcgaccgtgggtcccgccgacggtccgtccggtaggggaacggggtctaggggaggtgggacttccgtacggtaaggggtatttacgggtggacctacgtgggacgttaatttaactactaattaatttaactaacacggtaccttccgggaggaacggggccctaccttaccgacctatccctaccgaaggtaacaacctaaacttaacccgaaagtaaaaccgtaccggggtttaattaacgttaccgtaggtaaccaaaagttacggaaaccaacggtacccgtaaggaacggaacggacccgggaaaacggaacccgtaaccgggacccaaacgtaagttaaaccttacgtacggtacgaacggtaaaagtcgtacggtcgggtcgtttccgggttccggtaccggggttaccggg

SEQ ID NO: 399360 - DNA, 745 bp, Homo sapiens
  misc_feature: GZ8MTXP02FRB4Y.4.67.G01.1.454.CMB.2.raw
  modified_base (313)..(313): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggagcctggcacgaggccggggggtccctggacgactctcctgtgcacgcctctggattctagttttagaatgtctgccatcgaccgtcgggtcccnccgacgggtctcccggtaggggaacggggcgtgggtaggtggagtcgtacgagggtattaggcggcacgtgggactattaacgtactagttaattaactaacgacgtaccgttaccggtagggtaaacccggggtcccgtccgttttacccaacccctattcccgtaacccgaaacggaacgtaaaccctaaaactttaccccgaaaaaggtaaacccgtacggggtttacttaaacgttacgttacggaaacttaaaaacgtacgaaaaccgacggtacccgtagggaacgacggaccgggaacggaaccgaccgggacctaaactagttaaacttaccgtagttaacggaacgttaaaacggcgtttacccgggtaccggggtaccggttccggggtttacccgggaccgggggttacccggttaaaggg

SEQ ID NO: 399361 - DNA, 405 bp, Homo sapiens
  misc_feature: GZ8MTXP02GCKQO.4.67.G01.1.454.CMB.2.raw
  modified_base (356)..(356): a, c, t, g, unknown or other
  modified_base (366)..(366): a, c, t, g, unknown or other
  modified_base (394)..(405): a, c, t, g, unknown or other
tcagagcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgctctgtctcaggcagctatgtcttcggaactgggaccaagtcgaccgtcctgggtcagccccaaaggcccaaacccccatgtccactctcgttccccacccctcctccanagtcgcttcngacgcggggctggcaagggctacatagnnnnnnnnnnnn

SEQ ID NO: 399362 - DNA, 716 bp, Homo sapiens
  misc_feature: GZ8MTXP02G1W1M.4.67.G01.1.454.CMB.2.raw
  modified_base (199)..(199): a, c, t, g, unknown or other
  modified_base (206)..(206): a, c, t, g, unknown or other
  modified_base (246)..(246): a, c, t, g, unknown or other
  modified_base (263)..(263): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtgttttctagtggctaattttaaaggtgtcagtgtgaagtgcagntggtggngtcgtgggggaggcctggcacgaggccgggggggttcccngacgtctctcgtgcgcncgtctcgtgtattcgttagtttaagattgtctacgactagtccgtaccgtcgggcccgcgacggtccgtcgggtaggggacgggtcgtaggagtacggtcgtacgtaggtaggtacgtaggtccgacgtacgtcggacttagttaataatattaattaagtaaccgtacgtaccgtacggaagggaccgggtcctaccttaacccaccgtactaccgtacgaacgtaacaaacgtaaacgtaaccgaaacgaaacgtaacgttagtacgtacgtacgaacgtaaacgtaacgtaacgtaacgacgtaacggaacggaacggacggaaccggaaccggaacccgaaccgtaaacgtaacgttaacgttaacgtacgtaacggtaacgtaaacggtaacggttacggtaccgggttacggttaccggttaccgggttaccgggtacgggttacgg

SEQ ID NO: 399363 - DNA, 556 bp, Homo sapiens
  misc_feature: GZ8MTXP02I94BI.4.67.G01.1.454.CMB.2.raw
  modified_base (479)..(479): a, c, t, g, unknown or other
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccgggggggtccctgagactctcctgtgcagcctctggattcagttttagaatgtctgccatcgaccgtgggtccgccgaggctccgtggggaaggggctgggagtggatctcgagggattaggcggcacgtggacgtattatacagtattatacagactccgtagaacgggccgcttcaccaatcctccagagacaattccaaagacacggtatactctgacaaatgaaaccagtccagaacgngccgtagacacggtccaatatacttactgtacgacgaaaagcgtcgtcgggactggttcccggcggtccgggttaag

SEQ ID NO: 399364 - DNA, 683 bp, Homo sapiens
  misc_feature: GZ8MTXP02GKZX7.4.67.G01.1.454.CMB.2.raw
  modified_base (314)..(314): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgacgggccgggggggtccctggagactctcctgtgcagcctctggattcagttttagaatgtctgccatcgacctgggtcccnccgaggctccgtggggaagggctgggagtggatctgaggggtattaggcggcacgtggacgtattactacattaattaatacagtcctaccggtaggaaccgggggcctacttaccacctaatccgtacccaaggataaacctaaactttacccgaaaacgtaaccgaaccgggttgtaaactcccggttaaagaaaccgtaaaagtacgaaaccgtaggtaccgtaggaacggacggaccgggaacgggaacccgtaacccgggacctaaacgttaacgttaacgttacgtacggtaacgtaacgtaaaacgtcgttaccggtacggggtacggttaccgggtaccgggtaccggggttacgggtacg

SEQ ID NO: 399365 - DNA, 785 bp, Homo sapiens
  misc_feature: GZ8MTXP02I63G6.4.67.G01.1.454.CMB.2.raw
tcagagcactgtagcacgaccggtgctcgatttagagtatacatattgggtttggggtctgagagaggagcccagccctgggattttaaggtgttttcatttggtgatcaggactgaacagagagaactcaccatggagtttgggctgagctggtcttttctgtggctattttaaaaggtgtccagtgtgaagtgcagctggtggagtcgtgggggagcctggcacgaggccggggggtcctgagactctcctgtgcagcctcgtggtattctagttttagaatgtctgacctatcgaccgtgggtcccgccgagggcctccggtaggggaacggggctaggggaggtgggatcgtcgaggggtattaggtcggccacgttggacgtaatttactaactaattatttaactaacgaaacgtacccgtccgggttaggaaacggggcccgtacctttaccaaaccctattaccctacccgaaagaacgtaaccctaaacgtttacccccaaaaggtaaaccccgtaacggggttagttaaacttcccgtaaggtaacccttaaaaaagtcggaaaaaccacgtacccgtaaggaacggaaacggacccggaacgggaaacccggaacccgggttaacccgaaaaccgtaaatttaaacgttttaaacccggacgttaccgggaaaacggtaaaacgtaaccgttaacgggttacccggggtaccgttacgggggttttcccccgggacccgggggtttaacccgggggtacgttttaacccggggg

SEQ ID NO: 399366 - DNA, 770 bp, Homo sapiens
  misc_feature: GZ8MTXP02JRZTR.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagcgtggtggagtcgtgggggaggcctggcacgacgggcccgggggggtcctgacgactctcctgtcgcacgcctcgtggtattcgtagttttaagatgtctcgccagtcgacccgtcgggtcccgccgacggtcgtccggtaggggacgggtcgtgggaggtggtagtcgtacggtagggtagtttaggcggacgtacgtggacgttaattactaactattaattaacgtaaccgtacgtaaccgttacccggtaagggtaacccgggggtccccgttaccgtttacccgaaccctacgtttaccccctaacccgtaaacggaaccgtaaacccttaaaacccgtttaaaccccgaaaaacggtaaaacccggttaaaccgggtttaccggttaaacttcccgttaacgggaaaacttaaaaccggttaacggaaaacgtacccggtaaccggttaggaacggaccggaccggaaccgacgacccggactaaacctagttaacttcgtaacggacgaacgtaagtcgtaccggtacggtcggttcggtcccggtcgggtacggttaagg

SEQ ID NO: 399367 - DNA, 727 bp, Homo sapiens
  misc_feature: GZ8MTXP02F16FJ.4.67.G01.1.454.CMB.2.raw
  modified_base (304)..(304): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggccggggggtccctgagactctcctgtgcagcctctggattcagtttagaatgtctgccatgacctgggtccnccaggcctccgtggggaagggctggagtggatcgtcgagggattaggtcggcacgtggacgtattaatacatattaataacagaccgttaccgtaggaaacggggccccgtactttacccaaccctattccctacccgaagacgtaaacctaaactttaccccgaaaaagtaaaccgtaaccggggtttagtaaaactttccctaggaaccctaaaaagtccggaaaacccagggtaccccttagggaaaacggaccgggacccgggaaaagggaacccgaacccggggtaccccaaaataaactttaaacgtttaaacctggggttaaacgaacccggaaaaaaaggtaaccgttcccgggtaaccgggggtccgtttcgggggtttaacccccggccgggggtttaccccggggtaaacgg

SEQ ID NO: 399368 - DNA, 688 bp, Homo sapiens
  misc_feature: GZ8MTXP02I8R30.4.67.G01.1.454.CMB.2.raw
  modified_base (309)..(309): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttcttgtggctattttaaaaggtgtccagtgtgaagtgcagctggtggagtcgtgggggaggcctggcacgaggccgggggggtccctggagactctcctgtgcagcctcgtggattcgagttttagatgtctgccatcgacctgggtcccnccgagctccgtgggagggctggagtggatcgtcgagggtattaggcggcacgtggacgtattaatactagttattatacagtacctccggtaggaacggggcccgtacttaccacctactctacccgaaaggtacgaacctaaacttacccaaaagtaaaccgtacgggttacgttaactaccgttaggaacctaaaacgttacgaaaacctaacggggtaccccttagggaaacgggaccgggaccccgggaaaacgggaacccggtaacccgggacccaaaccgtaaactttaaacgtttaaccgtagttacggaaccgtaaaagtcgttaccgtcggggtacgtcggggtttccccggcggggtacccgggttagg

SEQ ID NO: 399369 - DNA, 712 bp, Homo sapiens
  misc_feature: GZ8MTXP02IFN2O.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttctgtggctattttaaaaggtgtccagtgtgaagtgcagctggtggagtcgtgggggagcctggcacgagggccgggggtcctgagactctcctgtgcacgcctcgtggtattctagttttagatgtctgccagtcgaccgtcgggtcccgccgacggtccgtccggtagggggaacggggtcgtgggaggtggactcgtacgagggtattaggtcggcgtacgtggacgtattaactaactagttaactttaataacgtacgtaccgtccggtagggaaaccgggtcccgtacttcccaaccgtacttccctaccgaagacgaaactaaacgttacccgaaaagtaaccgtaacgggttattaactcgtaacgaaactaaaacgtacgaaaccgacgtaccgtaggaacgggacgaacccgggaaaggacccgaaaccggtaccaaaccgttaattaaaccgttacgtcggttaaacgaaccgtaaaacggtcgtccggtaccggggtccgtttaccggggtccccgggtaccggggtaccgggtttaacgg

SEQ ID NO: 399370 - DNA, 585 bp, Homo sapiens
  misc_feature: GZ8MTXP02GFOOP.4.67.G01.1.454.CMB.2.raw
  modified_base (308)..(308): a, c, t, g, unknown or other
  modified_base (469)..(469): a, c, t, g, unknown or other
  modified_base (501)..(501): a, c, t, g, unknown or other
  modified_base (508)..(508): a, c, t, g, unknown or other
  modified_base (540)..(540): a, c, t, g, unknown or other
  modified_base (551)..(551): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtcgttttctagtggctaattttaaaaggtgtccagtgtgaagtgcagctggtggagtcgtgggggaggcctggcacgaggccggggggtcctgagactctcctgtgcagcctctggattcagtttagatgtctgccatcgaccgtgggtcccnccgaggcctccggtggggaaggggtcgtgggaggtggatctcgagggtattaggtcgggtccagttggacgtattataactattattaatacacgtactccggtaggaacggcccgtcttacaccctaattccaccaagacaacaacttaccaaagtaacncggtatactctgaacaaagtacgaacacgacnggaacgngaccgaggaaccgacggacactatattaacgngacgaacgaancgtcgtacggtcgtacggtccggacggtacgtag

SEQ ID NO: 399371 - DNA, 671 bp, Homo sapiens
  misc_feature: GZ8MTXP02H2UEB.4.67.G01.1.454.CMB.2.raw
  modified_base (184)..(184): a, c, t, g, unknown or other
  modified_base (202)..(202): a, c, t, g, unknown or other
  modified_base (218)..(218): a, c, t, g, unknown or other
tcagagcactgtagcacgaccggtgctcgatttagagtatacatattgggtttgggtctgagagaggagcccagccctgggatttttcaggtgttttcatttggtgatcaggactgaacagagagaactcaccatggagtttgggctgagcggtgtgtttctaggtcggctaattttaaaaggngtcagtgtgaagtgcagngtgtggagtcgtgggngcgtgcgacgacggccggggtccgtgagacgtcgtcgtgtcgcgcgctcgtgtagttacgtagttagtatgtcgtcgcgtacgtcgtccgtcggtccgccgcggtcgtcggtagggacgggtcggtaggtaggtggtacgtacgtacgtaggtagtacggtcgtacgtacgtacgtacgtagttaagttacgtattaacgttaactacgtacgtacgtacgtacggacggtaccgtaccgtaccgtacctacgtacgtacgacgaacgtaacgtaactaaccgaacgtaacgtacgtacgtacgtacgtacgtaacgtaacgtacgaacgacgacgtacggacggaacggaccgaacgaaccgaaccgaccgtaactaactaacgttaacgtacgtacgtaacgaacgtaacgtacggtacggtcggtcggtaccggtaccggtacggtacgg

SEQ ID NO: 399372 - DNA, 678 bp, Homo sapiens
  misc_feature: GZ8MTXP02FTJ0Z.4.67.G01.1.454.CMB.2.raw
  modified_base (376)..(376): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttctgtggcttaattttaaaaggtgtccagtgtgaagtgcagctggtggagtcgtgggggagcctggcacgaggcccggggggtccctggacgctctccgtgtgcagccctgtggtattctagtttagatgtctgccagtcgaccgtcgggtacccgccgaggtcctccggtagggggaacggggtcgtgggagtggattcgacgagggtattaggngactcgtgggactagttatactatattaacacgacgtacgttccggtaggaacgggtccctacttaccgaacctacttccgacccgaaagaccgtaactaaacttaccgaaaagaaccgtacgggtactaactccgtagaaacctaaagtacgaaaccgtacggccttagggaacgaccggaccgttacggggaaccgtaaccggaccaaacgttataaaacggttccgtagtaccgaaacggtaaaagccgttccggtaacgggccgtttaccgggttaccgggcccgggttaaggtacgg

SEQ ID NO: 399373 - DNA, 650 bp, Homo sapiens
  misc_feature: GZ8MTXP02FRC3N.4.67.G01.1.454.CMB.2.raw
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagctggtctttttcttgtggtcttaattttaaaaggtgtccagtgtgaagtgcagctgggtggaggtcgtgggggaggcctggcacgaggccgggagggggtccctgagactctcctgtgcacgcctgtggattctagttttagaatgtctgccagtcgaccgttcgggtcccgccgacggcctccggtgggggaacggggtcgtaggggaggtggatcgtacggagggtattacggtggcacggtggactaattatacattaattatacgacgtacgtccggtaggaacgggtcctccttacaacctatccctacaagaacgaactaaactaccgaaacgaaaccgtacggtagtactcgtagaacaaatacgaacagcctaggacgacggaccgaaggaaccgaccggaccaaacgtaattaacgttacgtacggtacgaaacgtaaaagtcgtaccggtccggggtcgttcggggttcccgggtcggggtttaccggg

SEQ ID NO: 399374 - DNA, 678 bp, Homo sapiens
  misc_feature: GZ8MTXP02I6K92.4.67.G01.1.454.CMB.2.raw
  modified_base (307)..(307): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtccctgagactctcctgtgcagcctctggattcagtttagatgtctgccatcgaccgtgggtcccncgaggctccgtggggaggctggagtggatctcgaggtattagtcggcacgtggacgtattacgtacattatactacagtactccggtagaacggggccctcttaccacctacgtcctacccaaggacaaactaacgttacccaaaagtaccgtaacgggttactaaagtccgttagaacctaaaagttacgaaaccgacgcctaggaacgacggaccggaaacggacccgaaccgggacccctaaaggtaaccttaagtttaaccggttacggtaacggtaacccggaaaaagtcgttaacccgggtaccgggggttcccggttaaccgggggtttcccccggtaaccgggggttcccggggtttaaacgg

SEQ ID NO: 399375 - DNA, 668 bp, Homo sapiens
  misc_feature: GZ8MTXP02ID4KP.4.67.G01.1.454.CMB.2.raw
  modified_base (287)..(287): a, c, t, g, unknown or other
  modified_base (520)..(520): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggagcctggcacgaggccggggggtccctgagactctcctgtgcagccctcgtggtattctagttttanaatgtctgccatcgaccgtgggtccccgccgaggcctccggtaggggaaggggtcgtagggaggtggatcgtacgaggggtattaggcggctacgtggacgtaatttaactaactatttaatttaaactacgtaacgtaccgttcccgggtagaaaccgggggtccctcttacccaacctactcctacccgagaacgtaactaaacgttaccaaaagaacccgtaacgggttntaactcgtagaacctaaaagtacgaaccacgtccgtagaacggagcccggaaaggtaacccgacggaccaactaattaacgtacgtaggtcgaaacgtaaagtaacgtcggtaccgggtcgtccggggttcccggcgggtaccggtag

SEQ ID NO: 399376 - DNA, 679 bp, Homo sapiens
  misc_feature: GZ8MTXP02JILIU.4.67.G01.1.454.CMB.2.raw
  modified_base (306)..(306): a, c, t, g, unknown or other
  modified_base (457)..(457): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggaggcctggcacgaggcccggggggtccctggagactctcctgtgcagcctctggattcagtttagaatgtctgccatgacctgggtccnccaggctccgtgggaaggggctggagtggatcgtcgagggattagtcggcacgtggcgtattatacatattatacagacgtccgtagaacggggcctcttacaccatctacccgaagacgaactaacttacccgaaagaaccgtacgggtnttaataccgtagaaccaaaagtacgaaaccacggaccctagggaacgaccggaaccgggaacgggaacccgtaacccgggacccaaacccgtaaactttaacgtttaaaccgtttaggtaacccggtaacgggaaaaaacgtccgttaacccgggtacccgggggttaccggtttcccgggggtttaccccggggtccgggggtaccccgggggtttaaagg

SEQ ID NO: 399377 - DNA, 639 bp, Homo sapiens
  misc_feature: GZ8MTXP02IYPCP.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctgggtggagtcgtgggggaggcctggcacgagggccgggggggtccctggagactctcctgtgcagccctctggattctagttttagatgtctgccatcgaccgtgggtcccgccgaggcctccggtggggaaggggcgtggagtggatcgtcgagggtattaggcggctacgtggacgtattacgtactattattatacagtaccgtcggtagacgggccctcgttccacctagtccctacgaagacgaacaacgttaccgaaacgaactacgggttatactctaagacctaaagtacgaacgacgacctaggaaacggcggaccggaacggaacccgaacggtacccaactacttaaactttacgtagtacgaaccggtaaaagtcgttcggtccgggtacgttcgggttacccggtcggggtacccgggttaacgg

SEQ ID NO: 399378 - DNA, 630 bp, Homo sapiens
  misc_feature: GZ8MTXP02F468X.4.67.G01.1.454.CMB.2.raw
  modified_base (312)..(312): a, c, t, g, unknown or other
  modified_base (566)..(566): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggagcctggcacgagggccgggggggtccctggagactctcctgtgcagcctcgtggattctagttttagatgtctgccatcgaccgtgggtcccnccgaggcctccggtaggggaaggggtctgggagtggatcgtcgagggtattaggtcggcacgtggacgtattatactatataatacagtactccgtaggaacgggccgtcttaccacctatcctaccgaagacgtaactaaacttaccaaaagaacttacgggtattacgtcttagaacctaaaatacgaaaacccgagaccctaggaacgacggacccgaggaacccacgggcctaaacagttaacttaccgngtacggacgtaaaagtcgttaccggtcgggtaccttcgggtttacccgcggggtaccggttagg

SEQ ID NO: 399379 - DNA, 613 bp, Homo sapiens
  misc_feature: GZ8MTXP02HNSCQ.4.67.G01.1.454.CMB.2.raw
  modified_base (279)..(279): a, c, t, g, unknown or other
  modified_base (488)..(488): a, c, t, g, unknown or other
  modified_base (550)..(550): a, c, t, g, unknown or other
  modified_base (562)..(562): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctgggtggagtcgtgggggagcctggcacgaggccggggggtcctgagactctcctgtgcacgcctcgtaggtacttntagttttagaatgtctgccatcgaccgtgggtccccgcgaggtcctccggtaggggaaggggcgtggaggtggatcgtacgagggtagttagcggctagcggtacgtattaatactattattaactactacgacctcggtaggaaacggtcccgcttaccactactcctaaccaggaacaactaacttacgaaacgaaccgaagggttntaacttccgtagaacctaatacgacacgtcacgacggacgacgaacgaccgacggtacctanaactacttacgngtacgaacgaagaaccgtcgtcgggtctcggtcccggtcggggtaccgtgg

SEQ ID NO: 399380 - DNA, 671 bp, Homo sapiens
  misc_feature: GZ8MTXP02IMEEV.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttttctgtggctattttaaaaggtgtccagtgtgaagtgcagctggtggagtcgtgggggagcctggcacgacgggccgggggtcctgagactctccgtgtgcacgcctcgtggtattctagttttagatgtctgccatcgaccgtcgggtcccgccgacggctccggtaggggaagggtcgtgggaggtggtactcgtcgagggtagttacggtcggacgtacgtggactaagtttaactactagtttaattacgtaaccgacgtacccgttcgggtacggtaaccggggcccttctacccgacctactccctaccgaagaaccgtaactaacgttaacccgaaagaacgtacggttatactacgtagaacctaaagtaccgaacgcgaccgtaggaacggacggaaccgacggaaccgaccggacctaagtaacttacgtaccgtagtaacgacggtaaaacgtcgtccggtcgggttaccgtcgggttcccggacggggttaccggtagg

SEQ ID NO: 399381 - DNA, 663 bp, Homo sapiens
  misc_feature: GZ8MTXP02HYGXX.4.67.G01.1.454.CMB.2.raw
  modified_base (182)..(182): a, c, t, g, unknown or other
  modified_base (201)..(201): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgcgttttctagtggctattttaaaaaggngtccagtgtgaagtgcagngtggtggagtcgtggggaggcgtggcgacgacggccgggggtcccgtgagactctctgtgcacgctctggatctagtttagtaatgtcgtgcatacgacgtcggtccgccgacgcgtccgtagggaaggggacgtaggtaggtggtagtactacgtaggtagttagtcggacgacgtacggacgtacgttaattaactattaaattaactaacgtaacgtaacgtaccgtacgtaacgggaccgtcgttacaccactacctaccacgaacgaactaaactaacctaaacgaaacgaacggtacgttagttacgtacgtaactaaacgtaagaaacgaaacgacgtacgacggacggacgaacggaacgaacggaccgaactaactaaagttaacgttacgtacgtacgaaacgtaacgtacgtaccggtacgttacggttccggtaccgggtaccgggtacg

SEQ ID NO: 399382 - DNA, 680 bp, Homo sapiens
  misc_feature: GZ8MTXP02GDJCR.4.67.G01.1.454.CMB.2.raw
  modified_base (414)..(414): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttattttaaaaggtgtccagtgtgaagtgcagctggtggagtcgtgggggaggccgtggcacgagggccgggggggtccctggagactctcctgtgcagcctcgtgtattcgtagtttagaatgtctgcctatcgaccgtcgggtcccgccgaggccgtccggtgggggaaggggtcgtggaggtggattcgtacgagggtagttaggtcggacgtacgtgggactaagttactactatattaanacgtagtaccgttcggtagaacggggtccctaccttaccacctatccctaccgaagacgaactaaacgttacccaaaagaacctacgggtatacttaccgtagaacctaaaagtgaaaacccgtaggtaccgtaggaaacggaccggtaccccgggaaaggtaccccgaacggacccttaaataagtttaaaccttacgtacgggaacgacgaaaagtcggttacgtcgggtccgttaccggttccggacggttccgggggttaag

SEQ ID NO: 399383 - DNA, 648 bp, Homo sapiens
  misc_feature: GZ8MTXP02GF528.4.67.G01.1.454.CMB.2.raw
  modified_base (297)..(297): a, c, t, g, unknown or other
  modified_base (317)..(317): a, c, t, g, unknown or other
  modified_base (360)..(360): a, c, t, g, unknown or other
  modified_base (532)..(532): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttctgtggcttaattttaaaaggtgtccagtgtgaagtgcagcgtggtggagtcgtgggggagccgtggcacgacgggcccggggggtcctgagtactctcctgtgcagcctcgtggtattctagttttagactgtcngccatcgaccgtgggtcccncgaggtcctccggtaggggaagggtcgtgggagtggattccgnggtaagggtatttacggcgggactacgtggacgttaattataacgattataacgtacagtccgtacggtaggaaccggtccgtacttaccgactacgtcctaccgaagacctaaacgtacttacgaaacgaacaccgggttatacgtcgtaacgacttaaaagacgaaaccncggtacgtacgaaagggaccgaaccggacggaccaacggacctaaactattaaacgtagtcgaacgacgaaaagtcgtcggtcggtaccggtggtacccggtcggtacggttaacg

SEQ ID NO: 399384 - DNA, 707 bp, Homo sapiens
  misc_feature: GZ8MTXP02IWJ9D.4.67.G01.1.454.CMB.2.raw
  modified_base (521)..(521): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtcttttctgtggcttattttaaaaggtgtccagtgtgaagtgcagctggtggagtcgtgggggaggccgtggcacgacggcccgggggggtccctggagactctcctgtcgcagccctcgtggtattctagtttagatcgtctgcctatcgtaccgtgggtcccgccgtaggccgtccggtaggggaacggggtcgtagggagtggacttccgtaggagggtattacggtcgaccgtacgtggacgtattaacgtactattacttaactacaacgtaccgttacccgggtaggaacccggggtcccgtacctttcccacctaactccctaccgaagacgaactaactaccgaaacgacgtaccggtntaactcgtagtaaaccaagttacgaaacgtacgaccgttaggaacggacggaccgggtaacgaaccgacccgggtacccaaaggttaaacctaagttttaccggacgttaggaacccggaaaagttaaccgttccggtcggggtccgttacgggtccccggtaccggggtttaccgggtttaacgg

SEQ ID NO: 399385 - DNA, 754 bp, Homo sapiens
  misc_feature: GZ8MTXP02JY5AK.4.67.G01.1.454.CMB.2.raw
  modified_base (326)..(326): a, c, t, g, unknown or other
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagcgtggtctttttcttgtggcttaattttaaaaggtgtccagtgtgaagtgcagctggtggagtcggtgggggaggccgtggcacgacgggcccgggggggtccctggagacctctcctgtgcacgcctcgtggattcgtagttttaagattgtctgccatcgaccgtgggtcccncgaggtcctccgggtaggggaacggggtcgtgggaggtggactcgtagaaggggtatttagggcggactacggtggattaatttaatactatttaattaactaacgtacgtaccgttaccggtaagggaaccgggtcccgtaccttacccacccgttactaccgtaaccgaagaaaccgtaaacctaaaccgttaacccgaaaacgtaaaccgtacgggttacgttacttacgtactaacgaaaagtaacgaaacgtaccggtacgtaaggaacgaccgggaccggaaacggaacccgtaacccggaacctaaacgttaaacttaacgttaaccggtacggtaacgaaacggtaaacgtccggttaccggggttaccgggttacgggttaccggggttccccggggtaccggggttaacggttaacgg

SEQ ID NO: 399386 - DNA, 539 bp, Homo sapiens
  misc_feature: GZ8MTXP02FHOEF.4.67.G01.1.454.CMB.2.raw
  modified_base (181)..(181): a, c, t, g, unknown or other
  modified_base (289)..(289): a, c, t, g, unknown or other
  modified_base (313)..(313): a, c, t, g, unknown or other
  modified_base (319)..(319): a, c, t, g, unknown or other
  modified_base (321)..(321): a, c, t, g, unknown or other
  modified_base (326)..(326): a, c, t, g, unknown or other
  modified_base (328)..(328): a, c, t, g, unknown or other
  modified_base (351)..(351): a, c, t, g, unknown or other
  modified_base (362)..(362): a, c, t, g, unknown or other
  modified_base (438)..(438): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgtttctaggtggctatttaaaaggngtcagtgtgaagtgcagctggtggagtcgtgggggaggcctggcagaggccgggggggtcctggagactctcctgtgcagcctctggattctagtttagaatgtctcncatcgcgtcggcgcgcgcgtcggnggaggngnggagngngtcgtgaggtagtagcgcgacgngcgtatatatntatatacagactcgtacgacgcgtctcacactacacagacaactaactacgaacaacgacgtagtactacgtaganaacacaacgacgacgtagacgacgacgacgacgacgacactactactacgtacgtacgacgacgaagtcgtcggtcggtcggtccggtacggtacggtacg

SEQ ID NO: 399387 - DNA, 565 bp, Homo sapiens
  misc_feature: GZ8MTXP02J067V.4.67.G01.1.454.CMB.2.raw
  modified_base (377)..(377): a, c, t, g, unknown or other
  modified_base (509)..(509): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaggtgtccagtgtgaagtgcagctggtggagtcgtgggggaggcctggcacaggcccgggggggtccctgagactctcctgtgcagccctctggattcagttttagaatgtctgccatgaccgtgggtccgccaggctccgtggggaaggggctggaggtggatctcgaggggtattagtcggcacgtggcgtattatacntattatacagacctccgtagaacgggcccgtcttcaccatctaccagacgaactaaattaccaaagaaacacgggtatactctgacaaaatgaaacagcctgagacgaccgagacacggctacactattacngtacgaacgtaaaagaagtccgtcggggcttgggtcccggcgggtacccgggtaag

SEQ ID NO: 399388 - DNA, 625 bp, Homo sapiens
  misc_feature: GZ8MTXP02FKHJQ.4.67.G01.1.454.CMB.2.raw
  modified_base (259)..(259): a, c, t, g, unknown or other
  modified_base (263)..(263): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtgtcgttttctaggtggctattttaaaaggtgtccagtgtgaagtgcagctggtggagtctgggggagcctggcacagccgggggggtccctgagctctcctgtgcngctntgtatctagttagtatgtctcgcatcgcgtcggtccgcgcgcgtcgtggagggcgtggagtggtagtcgtcgaggtagtagtcgcgtacgtgacgtattataactataattaataacgtacgtaccgtaccggtacggaccgggtaccgtccgttacctacctactacctaccgaacgacgtaaactaaactaaccgaaacgaaacgtaacgtacgtagtacgtacgtaacaaacgtaagaacgacgtacgacgacggacgaccggacggaccgaccgaccgaacgtaacgttacttacgtacgtacggaacgaacgtaacgtcggtcggtcggttcggtaccggtccgggtaccggtacgg

SEQ ID NO: 399389 - DNA, 612 bp, Homo sapiens
  misc_feature: GZ8MTXP02JVJU4.4.67.G01.1.454.CMB.2.raw
  modified_base (292)..(292): a, c, t, g, unknown or other
  modified_base (493)..(493): a, c, t, g, unknown or other
  modified_base (503)..(503): a, c, t, g, unknown or other
  modified_base (506)..(506): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggcttttttcttgtaggcttaattttaaaaggtgtccagtgtgaagtgcagctggtggagtcgtgggggaggcctggcacgaggccgggggggtccctgagactctcctgtgcagcctctggattcagttttagaatgtntcgcctatcgtaccggtcggtcccgacgaggcctccgggtaggggacgggtcgtgggtacggtggtactcgacggtaaggtacgttacggccgacgtcgtggacgttattaccgtatattattaactacaacgtcctcggtaggaacgggtcctcttacacctacgtcaccgagactactaactacgaacaacgtacggtntactcagaanaanacaacgacgacgacgacgacgacgacgacgaccgacactactactacgtacgtacgaacgaacgtaacgtcggtcggtcggtccggtccggtccggtacggtacgg

SEQ ID NO: 399390 - DNA, 609 bp, Homo sapiens
  misc_feature: GZ8MTXP02FPSD8.4.67.G01.1.454.CMB.2.raw
  modified_base (262)..(262): a, c, t, g, unknown or other
  modified_base (267)..(267): a, c, t, g, unknown or other
  modified_base (493)..(493): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctattttaaaaggtgtccagtgtgaagtgcagctggtggagtcgtgggggaggcctggcacgaggccggggggtccctgagactctcctgtgcngcctntggattctagtttagaatgtctgccatgacctgggccgccgaggcctccgtggggaacggggctggagtggatcgtcgagggtattaggtggcacgtggacgtattatactattattaataacagtaccttccggtaggaaacggggtacccgtcttacccaaccctagtcctaccgagaacgaaccaaactttacccaaaagaacgtacggtagtactctacganaaaacgtcgaaacacgtcctaggacgagaccgaaggacccgaacggccaacgtaattacttacgtgtacgaccgaaaagaactcgacggtcgtcggttcccggcgggtccggtagg

SEQ ID NO: 399391 - DNA, 792 bp, Homo sapiens
  misc_feature: GZ8MTXP02JQ344.4.67.G01.1.454.CMB.2.raw
  modified_base (398)..(398): a, c, t, g, unknown or other
tcagagcactgtagcacgaccggtgctcgatttagagtatacatattgggtttggggtctgagagaggagcccagccctgggattttcaggttgttttcatttggtgatcaggactgaacagagagaactcaccatggagtttgggctgagctggtctttttcttgtggcttaagttttaaaaggtgtccagtgtgaagtgcagctggtggagtcgtgggggaggccgtggcacgacggccggagggggtcccctgacgactctcctgtgcacgcctcgtggtacttcgtagtttaacgaattcgtctcgccagtcgaccgtcgggtaccgccgacggtccgtccggtgggggtaacggggcgtagggtaggtggactcgtcgaggggtagttacggnggctacggtggtacgtaattaatacgtaaattaattacgtaaacctacggtacccgtaccgggtacgggtaaaccggggtcccgtcttaacccacctaccttcccgtacccaaagggtaaacctaaaccctaaaccgtttacccgaaaaacgggttaaacccgtacggggtttaaacgttaccgttaacgtacggtaaaactaaagttaaccggaaaccaacgggtccgtaacgggaccggaacgggacccgggaaaaccggtaaccgaacccgggcccaaaacgttaacgttaacgttacgtacggggtacgaaaacgtaaacggttaccgtccggggttacccggggtccgggtttaccgggggtaccccggtttccgggggttaacccggg

SEQ ID NO: 399392 - DNA, 725 bp, Homo sapiens
  misc_feature: GZ8MTXP02GEKUQ.4.67.G01.1.454.CMB.2.raw
  modified_base (320)..(320): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggagccgtggcacgacgggccgggggggtccctggacgactctcctgtgcacgcctcgtggtattctagttttagaatgtctgccatcgaccgtcgggtccnccgacggctaccggtggggaacggggtctaggggacgtggacttctacggtaggggtatttacggcggcctacggttcgggacgttaattaacgtaactagtttaacttaataacgtaacgtaccgttaccgggtaagggaaaccgggggtccctactttacccgacctaactccgtaacccgaaaggacctaaactaaacgtttacccgaaaagaaccgtaaccggttagttaactacgttacgaacaaaagtacgaaaaccgtgacccgtaggaaacggagaacccggaaagggacctaaccggacccaaataaacttaacgttacgtcggaacgtaaccgaaaagtaacgttcccggtcgggtaccgttcggggtccccggtacggggtacccggtttaagg

SEQ ID NO: 399393 - DNA, 769 bp, Homo sapiens
  misc_feature: GZ8MTXP02IFEU2.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggtctattttaaaaggtgtccagtgtgaagtgcagcgtgggtggaggtcggtgggggaggtccgtggcacgacgggcccgggggggtcctggacgctcctcgtgtgcacgccctcgtggtattctaggttttagaagtgtctcgacctagtcgacccgtgggtcccgccgaggtcctcggtaggggagggcgtgggagtggatcgtacgaggtattaggccgactacgtggactattaactacgtagttaatttaacgtaaacgtacgtacccgttccgggtaaggggtaaaccgggcccgttactacccgaaccctacgttaccctaacccgggaaagaacccgtaaacgttaaaccttaaccggaaaaccgtaaccggttaacggggttacttaaacgtaccgttagaaaaccctaaaaggttaccgaaaccgtaacggtaccgtagggaaacgaccgggaccggaaacggacccggtaaccggaacctaaacgtaacgtttaaacgttaccggttagaaacggtacgaaaacgttcgttaccggggttaccggttccgggtttccgggtacccggggttaccgggtaccggggtttaagg

SEQ ID NO: 399394 - DNA, 618 bp, Homo sapiens
  misc_feature: GZ8MTXP02I5U3F.4.67.G01.1.454.CMB.2.raw
  modified_base (400)..(400): a, c, t, g, unknown or other
  modified_base (494)..(494): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttcttgtggtctaattttaaaaggtgtccagtgtgaagtgcagctggtgagtcgtgggggagcctggcacgaggccggggggtcctgacgactctcctgtcgcacgcctcgtggtattcgtagttttagaattggtcttggcctaatcgaccgtttcgggcccgccgtaggtcctccggtagggaacggggtctgggagtggactcgtacgaggtattagtcggacacgtggactattanaactatattataaccgtagaccgttacggagaacggggcctacttcgaacctatcgacaggacactaactacgaacgaacgtacggtatatacncgtaaaacaagtacgaacgacgacgacgacgacgacgacgaacgacgacactaactaactacgtacgtacgaacgaacgtaacgtacgtacggtacggtacggtaccggtaccggtacggtacg

SEQ ID NO: 399395 - DNA, 561 bp, Homo sapiens
  misc_feature: GZ8MTXP02FSECY.4.67.G01.1.454.CMB.2.raw
  modified_base (313)..(313): a, c, t, g, unknown or other
  modified_base (442)..(442): a, c, t, g, unknown or other
  modified_base (459)..(459): a, c, t, g, unknown or other
  modified_base (504)..(504): a, c, t, g, unknown or other
  modified_base (514)..(514): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagcgtggtctttttcttgtggctaattttaaaaggtgtccagtgtgaagtgcagctggtggagtcgtgggggaggcctggcacgacggccgggggggtccctggagactctcctgtgcagccctctggattcagttttagaatgtctgccatgacctcgggtccncaggcctccgtggggaaggggctggacgtggatcgtcgaggggtattaggtcggctacgtggacgtattaactaacgtataattaatacagtacctccggtagaacgggccgtcttcaccatctacagnacaatcaaagacaggtntagtctagactaaatcgaacagcctgacgagccgagacacggcanatacttacgngtacgacgtaaagcgtacgtcgggctacggtccgcggggtacggtag

SEQ ID NO: 399396 - DNA, 616 bp, Homo sapiens
  misc_feature: GZ8MTXP02IZKV1.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggctttttcttgtggctattttaaaaggtgtccagtgtgaagtgcagctggtggagtcgtgggggagcctggcacaggccggggggtcctgagactctcctgtgcagcctctggattcagttttagaatgtctgccatgaccgtgggtccgcgaggctccgtggggaagggctggagtggatcgtcgagggtattaggtggacacgtgggacgtattactactattagttatacgacgtccgtccgtaggaacgggcccgtctttaccacctatcctacccagtacgaactaacgttacaaagactacggtagtactacgtagaccaaagtaccgaaacgcgaccgtaggaacgacggaccgagggtacccaaaccgggccaaacgtattaacttacgtaccgttaagacgtaaaacgtcgtacgtcggggtacgtacgggttccggacggggtacccggttag

SEQ ID NO: 399397 - DNA, 662 bp, Homo sapiens
  misc_feature: GZ8MTXP02HD2JB.4.67.G01.1.454.CMB.2.raw
  modified_base (325)..(325): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagcgtggtggagtcgtgggggagcctggcacgacgggccggggggtccctggacgtactctcctgtcgacacgcctctggtattcgtagttttagagtgtctgcctagtcgtaccgtgggtcccncgacggctccggtggggaggctggaggtggatccgtagagggtattaggtcggctacgtggtacgtattacacgtattaattaacgtaacgacgtaccgtcgggagtaaccggggtcctcttacccgacctacgttcccacgagtacgaactaacgttaacccgaaagaaccgttaacgggtctttaaacgtctaacggtaaactaaaggtacaaacgtacgtaccgtagaacgtacggaacccggaagacccgacggactaactagttactacgtacgacgaaccgtaaagtccgtcggtacggtcgttaacgggtccggtacggttacggtacgg

SEQ ID NO: 399398 - DNA, 651 bp, Homo sapiens
  misc_feature: GZ8MTXP02FO717.4.67.G01.1.454.CMB.2.raw
  modified_base (265)..(265): a, c, t, g, unknown or other
  modified_base (311)..(311): a, c, t, g, unknown or other
  modified_base (505)..(505): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggtctaattttaaaaggtgtccagtgtgaagtgcagctggtggagtcgtgggggaggcctggcacgacggccggggggtccctgagactctcctgtgcngcctctggattctagtttagaatgtctgcatcgtacctgggtcccnccgaggtcctaccgtggggaaggggcgtggagtggactcgtacgaggggtattaggtcggacctacgtgggactaattaactaactatattaataacctagtacccgtacgtagggaaacggggtccctcttacaaccctatccctaccgaagacgtaaacctaaagttacccgaaaagaaccctaaggggttntaaacgtccgtagaaccaaaaagttggaaacccagccctaggaccggagaccggaagaccaccggtaccaagtattaacttacgagtacgaacgtaaaagcgttcggtccgggtcgttcgggttcccgggacggttccgggttaag

SEQ ID NO: 399399 - DNA, 653 bp, Homo sapiens
  misc_feature: GZ8MTXP02F9ZV2.4.67.G01.1.454.CMB.2.raw
  modified_base (314)..(314): a, c, t, g, unknown or other
  modified_base (326)..(326): a, c, t, g, unknown or other
  modified_base (380)..(380): a, c, t, g, unknown or other
  modified_base (491)..(491): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggagcctggccagacgggccgggggggtacctggagactctcctgtgcagcctctggattctagtttagaatgtctgccatcgaccgtgggtcccnccaggcctccgngggaggggctggagtggatctgagggtattaggtcgacacgtggacgtattaanacgtatattataacaagtactacccgggtagaaacggggccctcttaccaacctaactccctacccgaaggacaacctaaagttacccaaaagaaccgtaaccgggtttanaacttaccgtagaaacctaaaagtacgaaaaccgacgccgtaggaacgacggaaccggaacggaaccgaaccggaccttaaacatttaaaacgttcgtagtaacgaggaaaaacgtcgttaacggcggggtcgtacgggtcccggtccgggtaccggttaag

SEQ ID NO: 399400 - DNA, 639 bp, Homo sapiens
  misc_feature: GZ8MTXP02FXH4R.4.67.G01.1.454.CMB.2.raw
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggctaattttaaaaggtgtccagtgtgaagtgcagctggtggagtcgtgggggagcctggcacgaggccggggggtccctgagactctcctgtgcagcctctggattcagttttagaatgtctgccatgacctgggtcccgcaggcctcctggggaaggggctgggagtgggaatcctacgaggggtagttagtcgggccaacgtcgggacgtatttaacgtacattaattaataacagtaccttccgtagaaacgggccgtcttaccacgactctcagacgacaaacgtttccaaacgtaaacgaggttacgtatacgttgacaaaacttgaaacgagaccgtacgaagacgaccggacgggaacaaccgggacctaacgaacttagttaaactacgttacgaaccgaaaagtaagttccgtacggggtaccgttccggggttacccggtccggggtaccggggtttaacgg

SEQ ID NO: 399401 - DNA, 676 bp, Homo sapiens
  misc_feature: GZ8MTXP02FOPE6.4.67.G01.1.454.CMB.2.raw
  modified_base (288)..(288): a, c, t, g, unknown or other
  modified_base (312)..(312): a, c, t, g, unknown or other
  modified_base (390)..(390): a, c, t, g, unknown or other
  modified_base (513)..(513): a, c, t, g, unknown or other
  modified_base (538)..(538): a, c, t, g, unknown or other
  modified_base (621)..(621): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttctgtggcttattttaaaaggtgtccagtgtgaagtgcagctgggtggaggtcgtgggggaggcctggcacgagggcccgggggggtccctggagactctcctgtgcagcctctggattctagtttanatgtctgccatcgacctgggtccncgacggctccgtaggggacgggctggagtggactcgttacgaggggtattaggtcggacctacggtggacgtaattanactattattataccaggtacctcgggtacgggaaaccgggtcctactttcccgaactaacttcctaccgaagacgaacctaaagttacccaaaaggtaaccgtaaccggggtattaaaccgtntaacggaactaaaattacggaaacncgtaccggtagaacggacggaccgagggacccaacgggaccaacgtaattacgttaaccggtgtaacggaacgttaaaacggnggttcccgtacggggtaccgttcggggtttacccggacggggttccggtttaagg

SEQ ID NO: 399402 - DNA, 648 bp, Homo sapiens
  misc_feature: GZ8MTXP02FXTE4.4.67.G01.1.454.CMB.2.raw
  modified_base (552)..(552): a, c, t, g, unknown or other
  modified_base (587)..(587): a, c, t, g, unknown or other
  modified_base (611)..(611): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggtcttaattttaaaaggtgtccagtgtgaagtgcagcgtgggtggagtcggtgggggaggcctggcacgacgggcccggggggtccctggagctctccgtgtgcacgcctgtggtatctagtttagatgtctcgccatcgaccgtcgggtcccaccgtaggccgtcggtaggggaacgggtcgtagggaggtggacttccgtagacggggtattacggtcgaccgtacgtaggtacgtaattactaaacgtattaattaactaacgtacgtaccgtttaccggacgggtaaaccgggtccctcttacccgaaccctatacccgtaccaaaggaccaaactaaccgtaccgaaacgaactacgggacctatcgagtaccaaagtanaacgctacgagacgcgacgacgctaacggacctanacgttactagtcgaacgacgaaancggtaccgtcggtacgttcggtccggcggtacggtcg

SEQ ID NO: 399403 - DNA, 730 bp, Homo sapiens
  misc_feature: GZ8MTXP02IO664.4.67.G01.1.454.CMB.2.raw
  modified_base (316)..(316): a, c, t, g, unknown or other
tcagagcactgtagcacgaccggtgctcgatttagagtatacatattgggtttggggtctgagagaggagcccagccctgggattttcaggtgttttcatttggtgatcaggactgaacagagagaactcaccatggagtttgggctgagctggtctttttcttgtggcttaattttaaaaggtgtccagtgtgaagtgcagctggtggagtcgtgggggaggcctggcacgaggccggggggtccctgagactcctcctgtgcagccctctggtattcagttttagaattgtctgccatcgaccgtcgggtcccnccgacggcctccggtaggggaacggggctggggaggttggacttccgtacggtaggggtagtttaggtcgggaccgtacgttcgggaccgtagttttaacgtaacctatttaaagttttaaataaaccgtaagtaaccccgttcccgggtaaggggtaaaccgggggtccccgtacctttacccaaccctaacgttccctacccgtaagaacgtaaacctaaacttacccgaaaagaaaccgtacggttagttacttcgttagactaaaacgtaccgaaacgtacgacccgtaggaacggacggacccggaaggaacccgaacggacccaactaacttaacgttactacggtaacgacggaaaactcgttcgtaccggggtacgttccgggtaccggtcggggtaccggttaag

SEQ ID NO: 399404 - DNA, 533 bp, Homo sapiens
  misc_feature: GZ8MTXP01DDV5U.39.17.B06.1.454.CMB.2.raw
  modified_base (285)..(285): a, c, t, g, unknown or other
  modified_base (367)..(367): a, c, t, g, unknown or other
  modified_base (493)..(493): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttaccaaacaaataaaaactacttagcttggcaccagcaagaaaccaggacagcctcagagtgctcatttacngggcatccgtacccggggaatcccgggggtccctgaccgattcagtggcagcgatcgtgggaccagtatttcactctacacntcagcagcctgcaggctagaagatgtggtactagtttattactcgtacactaaatattaataattactactacagtactttcgaccgtaggggaaccaagtcgtaggagaataacaaacgacgtgnggtctgaccacactctgtcttcacttccttcccgctaacg

SEQ ID NO: 399405 - DNA, 505 bp, Homo sapiens
  misc_feature: GZ8MTXP01BVGU4.39.17.B06.1.454.CMB.2.raw
  modified_base (319)..(319): a, c, t, g, unknown or other
  modified_base (360)..(360): a, c, t, g, unknown or other
  modified_base (456)..(456): a, c, t, g, unknown or other
  modified_base (471)..(471): a, c, t, g, unknown or other
  modified_base (477)..(477): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaacaataaaaactacttagcttggcaccagcagaaaccaggacagcctcagagtgctcatttactgggcatcgtacccggggaatccgggggtccctgaccgnttcagtggcagcgatctgggaccaggtattcactctcaccntcagcagcctgcagctgaagatgtgctaagtttatactgtacacaaatattataagtactctacagtactttgccgtaggggaccaagtctagganataacaaacgactgngctgcnccatctgtcttcacttcttcccgctaac

SEQ ID NO: 399406 - DNA, 532 bp, Homo sapiens
  misc_feature: GZ8MTXP01EB7CB.39.17.B06.1.454.CMB.2.raw
  modified_base (281)..(281): a, c, t, g, unknown or other
  modified_base (356)..(356): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgtttatacagttaccaacaaataaaaactacttagcttggcaccagcagaaacaggacagcctcagagtgctcatttacnggcatctacccgggaatccggggtcctgaccgattcagtggcagcggatcgtggaccagtattcactctacaccntcagcagcctgcaggctgaagatgtggactagtttattactgtacacaataattataagtactctactagtactttggccgagggaccaaagtcgtaggacgataacaaacgttaacgtgttggctgttaccgacttacttcgtcgttccttactacttacccttccccgcctaac

SEQ ID NO: 399407 - DNA, 504 bp, Homo sapiens
  misc_feature: GZ8MTXP01CT6V1.39.17.B06.1.454.CMB.2.raw
  modified_base (208)..(208): a, c, t, g, unknown or other
  modified_base (423)..(423): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttanacagttccaaacaaataaaaactacttagcttggcaccagcagaaaccaggacagcctccagagtgctcatttactgggcatctacccggggaatccgggggtccctgaccgattcagtggcagcggatcgtgggaccagatttcactctacaccaatcagcagcctgcaggctgaagatgtgcagtttatatgtcacaatattataatactctnagtactttgcgtagggaccaagtctagagataacgaaacgactgttagctgcacatctgtcttcacttccttccccgctaa

SEQ ID NO: 399408 - DNA, 524 bp, Homo sapiens
  misc_feature: GZ8MTXP01BOEIT.39.17.B06.1.454.CMB.2.raw
  modified_base (366)..(366): a, c, t, g, unknown or other
  modified_base (488)..(488): a, c, t, g, unknown or other
tcagtcgcactagtcacgaccggtgctcgatttagtcgatagtgaagggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaacaaataaaaactacttagcttgtcaccagcagaaaccaggacagcctcagagtgctcatttactgggcatccgtacccggggaatccgggggtcccctgaccgattcgagtggcagcggatcgtgggaccagtatttcactctacaccntcagcagcctgcaggctgagatgtgctagtttattactgtcagctagtattagtagtacgtcctcgtagtacgtttcgggaccggggacctaagtcgtaggagataacgaaacgttactggngctgccttcattctgtcttcacttcctcccgctaac

SEQ ID NO: 399409 - DNA, 509 bp, Homo sapiens
  misc_feature: GZ8MTXP01DR1J3.39.17.B06.1.454.CMB.2.raw
  modified_base (207)..(207): a, c, t, g, unknown or other
  modified_base (219)..(219): a, c, t, g, unknown or other
  modified_base (345)..(345): a, c, t, g, unknown or other
  modified_base (369)..(369): a, c, t, g, unknown or other
  modified_base (476)..(476): a, c, t, g, unknown or other
  modified_base (482)..(482): a, c, t, g, unknown or other
  modified_base (493)..(493): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagaggccaccatcaactgcaagtccaaccagagtgttttanacagttccaaanaaataaaaactacttagcttggcaccagcaagaaaccaggacagccctcctagagtgctacatttactggcatccgtaccccggggaatcccgggggtccctgaccgattcagtggcagcgatcgngggaccagtattcactctacaccntcagcagcctgcagctagaagatgtggactagtttattactgtcacaatattaataatactctacagtacttgcgagggaccaagtctagagataacaaacgactgngctgcncatctgtctcncttccttcccgctaac

SEQ ID NO: 399410 - DNA, 561 bp, Homo sapiens
  misc_feature: GZ8MTXP01DAJ2H.39.17.B06.1.454.CMB.2.raw
  modified_base (208)..(208): a, c, t, g, unknown or other
  modified_base (290)..(290): a, c, t, g, unknown or other
  modified_base (368)..(368): a, c, t, g, unknown or other
  modified_base (383)..(383): a, c, t, g, unknown or other
  modified_base (403)..(403): a, c, t, g, unknown or other
  modified_base (408)..(408): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttanacagttaccaaacaaataaaaactacttagcttggcaccagcaagaaaccaggacagccctcaagagtgctacaatttacgngggacagtccgtaccccggggaatccccgggggtccctaggacccgtattcgagtggcagcgatcgtaggacccagtntttcactctacaccntcagcagcctagcagcaganagtgngtactagtttatactagtacactaatattaataactactctatacgtacgtttagccgaggtaaccagtcgtaggaagactaacgaaacgttacgtaggcgtcgtagccgaccttacttcgtacgttccttcacttcccgtccccgcttaacc

SEQ ID NO: 399411 - DNA, 502 bp, Homo sapiens
  misc_feature: GZ8MTXP01D3YTG.39.17.B06.1.454.CMB.2.raw
  modified_base (448)..(448): a, c, t, g, unknown or other
  modified_base (482)..(482): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaaacaaataaaaactacttagcttggcacagcagaaccaggacagcctcagagtgctcatttactgggcatcgtacccgggaatccggggtccctgaccgatcagtgcagcggatcgtggaccagtatttcactctacaccaatcaagcagcctgcagctagagatgtgctagtttatactgtcacaatatataatactctcagtactttggccaggggaccaagtctaganataacaaacgacgtagttggactgcacttatctntcttcattccttccgctaac

SEQ ID NO: 399412 - DNA, 570 bp, Homo sapiens
  misc_feature: GZ8MTXP01AN4AX.39.17.B06.1.454.CMB.2.raw
  modified_base (207)..(207): a, c, t, g, unknown or other
  modified_base (219)..(219): a, c, t, g, unknown or other
  modified_base (322)..(322): a, c, t, g, unknown or other
  modified_base (363)..(363): a, c, t, g, unknown or other
  modified_base (384)..(384): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgtttanacagttccaaanaaataaaaactacttagcttggcaccagcaagaaaccaggacagcctcctagagtgctcatttactggcatctacccggggaatcccgggggtccctgaccgnttcagtgcagcgatcgtgggaccagatttcactctacaccntcagcacgcctgcagctgaanatgtggctagtttatactgtacactaatattataactactcgtacagtactttcggacctaggggaaccctaagccgtaggagacgtaaccgaaaacgttaacgttgttacgggtctacggacgttacccgaagttccgttcgttccttttaccaacggtttcccttaaccccggttcgttaaccg

SEQ ID NO: 399413 - DNA, 593 bp, Homo sapiens
  misc_feature: GZ8MTXP01D00SS.39.17.B06.1.454.CMB.2.raw
  modified_base (210)..(210): a, c, t, g, unknown or other
  modified_base (223)..(223): a, c, t, g, unknown or other
  modified_base (289)..(289): a, c, t, g, unknown or other
  modified_base (378)..(378): a, c, t, g, unknown or other
  modified_base (402)..(402): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgcaagtccaaccagagttgttttanacagttaccaaanaaataaaaactacttagcttggcacagcaagaaaccaggacagcctacagagtgctctatttacgngggcagtccgtaaccccggggaatccccgggggtccctaggacctattcagtggcagcgatcgtgggaccagtatttcactctaccacntcagcacgcctgcaggctagaagntggtgtacttaagtttattactagtacaactaattaattaacttaacgttaccttccttacgtaagttacgtttcggaccgtaaggggaacccaagtcgttaggaatacgtaacaaaacgttacgtggttacggtactcgaccgttacttacttcgttcgttaacttcacttcccttaacccgccgtaacg

SEQ ID NO: 399414 - DNA, 573 bp, Homo sapiens
  misc_feature: GZ8MTXP01ADFKW.39.17.B06.1.454.CMB.2.raw
  modified_base (256)..(256): a, c, t, g, unknown or other
  modified_base (283)..(283): a, c, t, g, unknown or other
  modified_base (310)..(310): a, c, t, g, unknown or other
  modified_base (317)..(317): a, c, t, g, unknown or other
  modified_base (344)..(344): a, c, t, g, unknown or other
  modified_base (357)..(357): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaaacaataaaaactacttagcttggcaccagcagaaaccnggacagcctcagagtgctcatttacgnggcatccgtaccgggagtccgggtccngaccgtntcgagtgcagcgatcgtaggaccagtnttcactctacacntcagcacgcctgcgaggctagaagtagtggtgtacttagtttacttactacgtacctaactaattattaataacttactacctactacgttacgttcggaccgtaacgggaccaagtcgtaggaacgtaactaacgaaacgttacgtggttacggtactacgaccgttaccttacgttccgtcgttccttactaccttcccgttccccgcctaacg

SEQ ID NO: 399415 - DNA, 555 bp, Homo sapiens
  misc_feature: GZ8MTXP01BZCW4.39.17.B06.1.454.CMB.2.raw
  modified_base (367)..(367): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttaccaaacaaataaaaactacttagcttggcaccagcaagaaaccaggacagcctcagagtgctcatttactgggcatccgtacccggggaatccgggggtccctgaccgattcagtggcagcgatcgtgggaccagtatttcactctacaccntcagcagcctgcagctgaagtatgtgactagtttattactgtacaactaattaattaattaactacttaccgtactagttacttttcgggacccgagggggaaccaagtccgtaggacgaataacgaaacgactggttggactgaccacttacttcgtcgtccttcacttcccgtttcccgcctaacg

SEQ ID NO: 399416 - DNA, 565 bp, Homo sapiens
  misc_feature: GZ8MTXP01BLHAY.39.17.B06.1.454.CMB.2.raw
  modified_base (279)..(279): a, c, t, g, unknown or other
  modified_base (286)..(286): a, c, t, g, unknown or other
  modified_base (370)..(370): a, c, t, g, unknown or other
  modified_base (396)..(396): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgttttatacagttaccaaacaaataaaaactacttagcttggcaccagcaagaaaccaggacagcctcagagtgctnatttacnggcatccgtacccgggaacgtcccggggtccctgaccgtattcaggtcggcgagcggatcgtggaccagtattcactctacacntcagcacgcctgcagctagaagtagnggtgtacttagtttattactagtacaactaattaattaataacgttacttcctactagttaccgtttcggaccggtagggaaccagtcgtaggaagactaacgaaacgttaaccgtgttcggactcgaccgcttactctgtccttacacttcccttccccgaactaacg

SEQ ID NO: 399417 - DNA, 602 bp, Homo sapiens
  misc_feature: GZ8MTXP01EFKRG.39.17.B06.1.454.CMB.2.raw
  modified_base (207)..(207): a, c, t, g, unknown or other
  modified_base (219)..(219): a, c, t, g, unknown or other
  modified_base (282)..(282): a, c, t, g, unknown or other
  modified_base (364)..(364): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgtttanacagttccaaanaaataaaaactctagcttggcaccagcaagaaaccaggacagcctcagagtgctctatttacngggcatccgtacccggggaatccgggggtccctagaccgtattcgagtggcagcgatcgtggaccagtattcactctacacntcagcagcctgacagctagaagagtgtggacttaaggtttattactgtacaacctaattaattaattaacgttacttacctactacgttacgttttcggaccgtaacggggaaccaagtcgtagggtaagaacgttaaaccgaaacgttaaacgtggttacgggaccttacgaccgttacccttagtttccgttacgttcctttacctacgttccccgtttaaccccgccgttaaccg

SEQ ID NO: 399418 - DNA, 357 bp, Homo sapiens
  misc_feature: GZ8MTXP01EFZME.39.17.B06.1.454.CMB.2.raw
  modified_base (243)..(243): a, c, t, g, unknown or other
  modified_base (247)..(247): a, c, t, g, unknown or other
  modified_base (261)..(261): a, c, t, g, unknown or other
  modified_base (272)..(272): a, c, t, g, unknown or other
  modified_base (277)..(277): a, c, t, g, unknown or other
  modified_base (341)..(341): a, c, t, g, unknown or other
  modified_base (346)..(357): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctagtgggtcggggagttatgtctggggccagggaccctggccaccgtctcctcagcctccaccaagggcccatcggtcttccccnggcnccctgctccaggcncacctccgagngcacngcgccctggctgcctggtcaaggactactccactagtgacgactgacgcgggctggcaaggcgnatagnnnnnnnnnnnn

SEQ ID NO: 399419 - DNA, 699 bp, Homo sapiens
  misc_feature: GZ8MTXP01D68LY.39.17.B06.1.454.CMB.2.raw
  modified_base (295)..(295): a, c, t, g, unknown or other
  modified_base (393)..(393): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgaggagggccaccatcaactgcaagtaccaaccagtagttgttttatactagttaccaaacaaataaaaactacttagcttggacacagacaagaaaccaggacagcctaccagagtgctctaatttacngggactacgtccgtaaccccggggaagttccccgggggtccctaggacccgtattcgagtggacaggcgatcgtgggaccagtatttcactctacacntcagcagcctgcaggctagaagtatggtagtacgttaagttttacttacgttcgtaacctaacctaaatttaactttaaacttaaacttacccttccttacgttaacgttaccggttttacggacccggtaaacgggggtaaaccctaaaggtacccgttaggggtaaacgtaacgtaaaaccgtaaaaccgggttaaaccgttcggggttacggtccgttaacgggaccccttaacggttaacctttccgttaacggtttcctttccgtaaccgtttccccttaaccccgttaaccctttaaccg

SEQ ID NO: 399420 - DNA, 355 bp, Homo sapiens
  misc_feature: GZ8MTXP01DKDU4.39.17.B06.1.454.CMB.2.raw
  modified_base (247)..(247): a, c, t, g, unknown or other
  modified_base (261)..(261): a, c, t, g, unknown or other
  modified_base (343)..(343): a, c, t, g, unknown or other
  modified_base (349)..(355): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcgggtagttatgtctggggccagggaaccctggccaccgtctcctcagcctccaccaagggcccatcggtcttcccctggcnccctgctccaggancacctccgagagcacagcggccctgggctgcctggtcaaggcctacttccactagtgcgactgacgcgggctggcaagggcncatagnnnnnnn

SEQ ID NO: 399421 - DNA, 551 bp, Homo sapiens
  misc_feature: GZ8MTXP01DAL2F.39.17.B06.1.454.CMB.2.raw
  modified_base (280)..(280): a, c, t, g, unknown or other
  modified_base (364)..(364): a, c, t, g, unknown or other
  modified_base (374)..(374): a, c, t, g, unknown or other
  modified_base (386)..(386): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttaccaacaaataaaaactacttagctggcacagcaagaaacagacagcctcagagtgctcatttacnggcatccgtacccgggaactccgggggtcccctgaccgattcgagtggcagcggatcgtggacccagtatttcactctccaccntcagcagccngcagctagaagngtgtgtactagtttacttactgtactactaaattattaataaattactcctactaagttacgtttcgaccggtaggggaaccaaggtccgtagggaatactaaacaaacgacgtaggttggactcgaccaccttatcttgttccttctacttccttcccgcctaa

SEQ ID NO: 399422 - DNA, 626 bp, Homo sapiens
  misc_feature: GZ8MTXP01AE7Q0.39.17.B06.1.454.CMB.2.raw
  modified_base (210)..(210): a, c, t, g, unknown or other
  modified_base (292)..(292): a, c, t, g, unknown or other
  modified_base (376)..(376): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgttttaanacagttaccaaacaaataaaaactacttagcttggcaccagacaagaaaccaggacagcctactagagtgctctatttacgngggcagtccgtacccggggatcccggggtccctgaccgattcgagtggcagcgatcgtagggaccagtattcactctaaccacntcagcacgcctgaccgagctagaagtagtgtggacttagtttacttactagtacctaacctaaattaattaacttaacttacttaccttacgtaacgttaaccgttttcggaccggtaacggggtaacccgaaggtaccgtaggtaaacgtaacgttaaaccgaaaacggttacgtaggttcggtacgttcgaccgttaccgttacttcgttaccttctttcctactttcccgttcccgttcgttaaccg

SEQ ID NO: 399423 - DNA, 784 bp, Homo sapiens
  misc_feature: GZ8MTXP01DGQ0N.39.17.B06.1.454.CMB.2.raw
  modified_base (298)..(298): a, c, t, g, unknown or other
  modified_base (431)..(431): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgacaagtccaacagtagttgttttaatactagttaccaaacaaattaaaaactacttagcttggacacagacaagaaaccaggacagcctctaagagtcgctactatttacgngggactagttacccgtaaccccggggtaacgttccccgggggtacccctagacccgtattcgagggttcggcgaggtcggtaactcgtacggggtaacctaggttacttttcgaacctcctaacccaaacgtntacccgaaagcccgaacgtccccgttaggacccgtaagggtaccgttaggaaaacggtaggttacggttagggttaaccgtttaaagggtttttaactttaacgtttaccggttaacccttaaaacccgttaaaagtttaaacttttaaacctttaaacggtttaaccctttaccccgtttaaccgttaacgtttaaccggtttttaccgggacccggtaaaccgggggtaaacccgtaaacggtaccggttaaggaaccgtaaacgttaaacgtaaacggttaacgttcggttacggtcgttcgaccttcgttacttcttacgttcttactcttcctcccgttccgttaacg

SEQ ID NO: 399424 - DNA, 634 bp, Homo sapiens
  misc_feature: GZ8MTXP01EWT7X.39.17.B06.1.454.CMB.2.raw
  modified_base (286)..(286): a, c, t, g, unknown or other
  modified_base (298)..(298): a, c, t, g, unknown or other
  modified_base (391)..(391): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtcccaacagtagttgttttaatactagttaccaaacaaattaaaaaactacttagcttaggacaaccagacaagaaaccaggacagcctacagagtnctacatttacgnggacactccgtaaccccggggaagtccccgggggtcccctggaccgtattcgaggtggacagcggatcgtgggacagtattcactccaacacntcagcacgcctgcaggctagaagagtggtagtacgttaagttttactttactacgtacaaacctaaattaatttaaacttaacgttaaccttaccgttaactaacgttacgtttccggaccgtaacggggtaaccaagtacgtaggaacaagtaaacgtaaaacgttacgtacggttacggtacgtcgaccgttaccttagttccttcgttccttactccgttaccttccccgttaactaacg

SEQ ID NO: 399425 - DNA, 612 bp, Homo sapiens
  misc_feature: GZ8MTXP01AVAEJ.39.17.B06.1.454.CMB.2.raw
  modified_base (298)..(298): a, c, t, g, unknown or other
  modified_base (404)..(404): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagaggccaccatcaactgacaagtccaacagagttgtttatacagttaccaaactaaataaaaactacttagcttaggacaccagacaagaaaccaggacacgccctacctagagtcgctactatttacgnggcagtccgtacccggggtacgtcccgggggtccctacggacccgagttacgaggccggcgaggcgggtactaggacgaccctaggtactttcacctctaccaccnctcaacgcacgtcctggacaggactagaagtgtggtacgtacttaaggtttattactgtacgagtactaagtttattaacggttagttacgttcctagtacgttacgtttcgggaccggggaactagtccgtaggaacgtagtaaccgaaacgacgtggttacgctggaccacttacgtctacgttctactcttccctaaccgctaac

SEQ ID NO: 399426 - DNA, 644 bp, Homo sapiens
  misc_feature: GZ8MTXP01AXP9B.39.17.B06.1.454.CMB.2.raw
  modified_base (208)..(208): a, c, t, g, unknown or other
  modified_base (222)..(222): a, c, t, g, unknown or other
  modified_base (257)..(257): a, c, t, g, unknown or other
  modified_base (281)..(281): a, c, t, g, unknown or other
  modified_base (290)..(290): a, c, t, g, unknown or other
  modified_base (394)..(394): a, c, t, g, unknown or other
  modified_base (403)..(403): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagaggccacatcaactgacaagtccaacagagttgtttaanactagttaccaaanaaataaaactacttagcttggcacagcaagaaacnggacacgcctacagagtcgtactntatttacgngggactagtccgtaaccccggggaagtcccgggggtccctaggaccgtatcgagtcggacgaggcggtatcgtagggaacctagtactttcactctaaccaccntcacgcacnccgtagcgagctagaagtgtggtgattagtttatacgtactacaactaaattacttaaactaactaccttactacgttaacgttacgtttacggaccgtaacggggaaccctaagtccgtaaggaactaacgtaaacgtaaaccgttaacgttggacgtaccgtacggttaccgttaaccttacgtttaacctcggtttaaccgtacctacctttaccccgttaaccccgaaccgttaacg

SEQ ID NO: 399427 - DNA, 669 bp, Homo sapiens
  misc_feature: GZ8MTXP01CPBFB.39.17.B06.1.454.CMB.2.raw
  modified_base (277)..(277): a, c, t, g, unknown or other
  modified_base (293)..(293): a, c, t, g, unknown or other
  modified_base (385)..(385): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgacaagtccaaccagagtgttttatacagttaccaaacaaataaaaactacttagcttggacaccagacaagaaaccaggacagccctcagngtcgctctatttacgnggctatccgtaaccccggggaacgtccccggggtccctcggaccgtattcgaggtggcaggcggtatcgtggaccagtattcactctacacntcagcacgcctgactaggctagaagtatggtagtacttagtttacttactacgtacctaacctaaatttaacttaacttaaacgttacccttaccttaacgttaacggttaaccgttttcgggaccccgtaaagggggtaaccctaaaggtccgttaagggaacgtaaacgtaaacccgtaaaacggttaaccgtttgggacgggtacccttacgacccaaccgttacttaaccgttacgtttccttccgtactttccccgtttaacccccgaacgtttaaccg

SEQ ID NO: 399428 - DNA, 639 bp, Homo sapiens
  misc_feature: GZ8MTXP01D0EB8.39.17.B06.1.454.CMB.2.raw
  modified_base (302)..(302): a, c, t, g, unknown or other
  modified_base (415)..(415): a, c, t, g, unknown or other
tcagtcgcactagtcacgaccggtgctcgatttagtcgatagtgaaggggcagcaagatggtgttgcagacccaggtcttcatttctctgttgctctggatctctggtgccgaacggggacatcgtgatgacccagtctccagacctccctggctgtgtctcgtgggcgagacgggccaccatcaactgacaagtccaaccagtagttgttttaatactagttaccaaactaaataaaaaactacttagcttaggacaccagacaagaaaccaggacacgcctcagagtgctatatttacgnggctacgtacccgtacccggggacgttccccgggggtcccctaggaccgtatttcgaggtcggacgaggcggtatcggtgggacctaggtactttccgacttctaaccaactntcaacgccacgccgtagcgaggtctagaagtagtggtagtacgttaagtttattactagtaccaactaaattaattaataacttaccttctacgtacgttacgttcggacgacgggaacctagtcgtaggaacgtaagaaaccgtaaacgttagtcggttacgtcgtacgaccttacgttacttcgttacgttcttacctaccttacccttcccgaacttaacg

SEQ ID NO: 399429 - DNA, 573 bp, Homo sapiens
  misc_feature: GZ8MTXP01A5CG7.39.17.B06.1.454.CMB.2.raw
  modified_base (222)..(222): a, c, t, g, unknown or other
  modified_base (261)..(261): a, c, t, g, unknown or other
  modified_base (289)..(289): a, c, t, g, unknown or other
  modified_base (334)..(334): a, c, t, g, unknown or other
  modified_base (380)..(380): a, c, t, g, unknown or other
  modified_base (394)..(394): a, c, t, g, unknown or other
  modified_base (404)..(404): a, c, t, g, unknown or other
  modified_base (412)..(412): a, c, t, g, unknown or other
  modified_base (539)..(539): a, c, t, g, unknown or other
  modified_base (546)..(546): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagaggccaccatcaactgcaagtccaaccagagttgttttatactagttaccaaanaaataaaaactacttagcttggcaccagacaagaaaccnggacagcctcagagtgctctagtttacngggacatccgtacccggggaactcccgggggtccctggacccgtnttcgagtggcagcggtactcgtagggacagtacttcactctacacntcagcagcctgacngctagaagtntggtacgnttagtttattacctgacctaactaattaattaataacggttctaccgtacgtacgttacgtttcgggaccgtaaggggaccaagtccgtagatacgaactaaaacgctaggcgtacgcgaccacttntaacgtnttcctctacttccctaacccgcgtaac

SEQ ID NO: 399430 - DNA, 816 bp, Homo sapiens
  misc_feature: GZ8MTXP01D7RRD.39.17.B06.1.454.CMB.2.raw
  modified_base (210)..(210): a, c, t, g, unknown or other
  modified_base (291)..(291): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgcaagtccaaccagagttgttttanacagttaccaaacaaataaaaactacttagcttggcaccagacaagaaaccaggacagcctcagagtgctactatttacgngggacataccgtaaccccggggaacttccccgggggtcccctaggaacccgtatttccgaagggttcggaccgaggtccgggtaattcggtacggggtaaccaggttaacttttcccaacccttcctaacccaaccctgttaccaacgggaccaacggtccccgttagggaccgtaagggtaccgtaagggtaaaggtaaggttcgggttagggtacccgtttaaacgggttttttaatttaccggttacgtaaccgttaaaaccccttaaatttaaactttaaaacttaaaccgtttaaccctttaccccgttaaccgttaaccggtttaaccggtttttaccgggaccccgggttaaacgggggtaaaccccgtaaaggtacccgtaaggggtaaacgtaacgttaaaacccgaaaacggttaaccggttaggttacggtacgttacggaccgttaacccttaacgttccttacgtttccttaccgtaaccgtttccccgttaaccccgttaacccttaaccg

SEQ ID NO: 399431 - DNA, 667 bp, Homo sapiens
  misc_feature: GZ8MTXP01CQBWU.39.17.B06.1.454.CMB.2.raw
  modified_base (298)..(298): a, c, t, g, unknown or other
  modified_base (402)..(402): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgacaagtccaaccagagttgttttatactagttaccaaactaaataaaaaacttacttaagcttaggacaccagacaagaaaccaggacacgcctcagagtgctcatttacgnggacacgtccgtacccggggaacgtcccgggggtacccctacggaccgtattcgagtggctaggcggtatcgtagggacctaggtatttcgactcctaacaccntccagcacgcctaggcaggctagaagtagtgtaggtacttagtttacgttactagtactaacctaattaatttaattaacttaacttaccgttacgtaacgttaccgttttaccggacccggtaacggggtaccgaacggtaccgtaagggtaacgtaacgtaacgtaaaacggttacgtacggttaggtaccgtggacccgttaaccttacgttccgtcgtttaaccttaccgtaccttcccctttaaccccgttccttaaccg

SEQ ID NO: 399432 - DNA, 694 bp, Homo sapiens
  misc_feature: GZ8MTXP01CPHT3.39.17.B06.1.454.CMB.2.raw
  modified_base (214)..(214): a, c, t, g, unknown or other
  modified_base (228)..(228): a, c, t, g, unknown or other
  modified_base (322)..(322): a, c, t, g, unknown or other
  modified_base (639)..(639): a, c, t, g, unknown or other
tcagtcgcactagtcacgaccggtgctcgatttagtcgatagtgaaggggcagcaagatggtgttgcagacccaggtcttcatttctctgttgctctggatctctggtgccgtacggggacatcgtgatcgacccagtctccagactccctggctgtgtctcgtgggcgaggacggccaccatcaactgacaagtccagccacagttagtttanacacgaccctaaanaataactaaactaacttaacgttgtatacaagacaaagtaaacgttacggaccaacgtccctaccgtaaacgccgtacttactacgttttccgngggtacctaacgtaccccggtaacccggggtaactccccgggggtaccctaggaccgtattcgaggtcggcgaggccggtagtcgggactacgtactttcactctacaacatcagcacgccctacgacgggctagaagttgtggtacggtacttaggttttaactacgtcgtaacgacggagtaaggtaattagttaggtaactttacggtttccggggtacggttaacgggttacccggaaccggtaaacgggacgtaaacggggtcgtaaacctaacggaaaacgtcgtcggtacggttcctacgacctaccgtnttaccggttcttccgttaactaccgttccctccgacttacgtcgttaacgtaacg

SEQ ID NO: 399433 - DNA, 417 bp, Homo sapiens
  misc_feature: GZ8MTXP01E0JFL.39.17.B06.1.454.CMB.2.raw
  modified_base (274)..(274): a, c, t, g, unknown or other
  modified_base (394)..(397): a, c, t, g, unknown or other
  modified_base (399)..(417): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaacccggccctctatgggtcggggagttatgtctggggccagggaacccctggcccaccgtctcctcacgccctccaccaagggccccattcggtccttcccccctggccgccctgctcccaggacnccacctcgagagcacgacgccggcccgtggctcgccgtggacaacggtacctacctccacgtaggtcgacgtacgtcggacggcgggtcgtaggaccgaacgggccgacgtaacgtaggnnnnannnnnnnnnnnnnnnnnnn

SEQ ID NO: 399434 - DNA, 614 bp, Homo sapiens
  misc_feature: GZ8MTXP01EAM5Q.39.17.B06.1.454.CMB.2.raw
  modified_base (212)..(212): a, c, t, g, unknown or other
  modified_base (238)..(238): a, c, t, g, unknown or other
  modified_base (279)..(279): a, c, t, g, unknown or other
  modified_base (289)..(289): a, c, t, g, unknown or other
  modified_base (585)..(585): a, c, t, g, unknown or other
tcagtcgcactagtcacgaccggtgctcgatttagtcgatagtgaaggggcagcaagatggtgttgcagacccaggtcttcatttctctgttgctctggatctctggtgccgaacggggacatcgtgatgacccagtctccagacctcctggctgtgtctcgtgggcgagacggccaccatcaactgacaagtccaacagtagttgttttanactagttaccaaactaaataaaactnttagcttgacacagcaaagaaccaggacagcctacagagtnctatattcgnggctagtaccgtaaccggacgtccggggtcctaggactattacgaggtcgacgaggtacgtagtcggtacggacacgttatttaccacttccaacaacctctacacgacacgtcgtaggacgtacgtatagagtagtcgtaggtatttaaggtttacttacgtactaacaactaaagttaatttaactaacttactaccgtactaacgttacgtttacggaccgtaacgggaacctaaggataggaataactaacgaaacgttacgtgttacggtcttacacgttacttactcttnttaactctaccttcttaacccgcgttaac

SEQ ID NO: 399435 - DNA, 544 bp, Homo sapiens
  misc_feature: GZ8MTXP02HMTWY.39.17.B06.1.454.CMB.2.raw
  modified_base (378)..(378): a, c, t, g, unknown or other
  modified_base (383)..(383): a, c, t, g, unknown or other
tcagtcgcactagtcacgaccggtgctcgatttagtcgatagtgaagggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaaacaataaaaactacttagcttggcaccagcagaaaccaggacagcctcctagagtgctcatttactgggcatctacccgggaatccggggtcctgaccgattcagtggcagcggatctgggaccagatttcactctcacatcagcagcctgcagctgagangtggngtagttattatatacacaataattaataaataactactactactacgttacgtacgacggaacgaacgacgtagagaagtaacgtaaaacgaaacgtacggtacggtacgtacgacaaccactaacgttacgttacttactacttaccttcccgtacctac

SEQ ID NO: 399436 - DNA, 492 bp, Homo sapiens
  misc_feature: GZ8MTXP02G6CZ3.39.17.B06.1.454.CMB.2.raw
  modified_base (208)..(208): a, c, t, g, unknown or other
  modified_base (353)..(353): a, c, t, g, unknown or other
  modified_base (412)..(412): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttanacagttccaaacaataaaaactacttagcttggcaccagcagaaaccaggacagcctctagagtgctcattactggcatctaccgggatccggggtcctgaccgatcagtggcagcggatcgtggaccagatttcactctcaccntcagcagcctgcaggctgaagatgtggcagtttatactgtcacaatatataatactctnagtactttgcctaggggaccaagctaggagatacaaaacgactgtaggctgacaccgatctgtctcactcttcccgctac

SEQ ID NO: 399437 - DNA, 494 bp, Homo sapiens
  misc_feature: GZ8MTXP02GMMCD.39.17.B06.1.454.CMB.2.raw
  modified_base (356)..(356): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccatactccctggctgtgtctctgggcgagagggccaccatcaactgcaagtccaaccagagtgtttatacagttccaacaataaaactacttagcttggcaccagcagaaaccaggacagcctcctagagtgctcatttactgggcatctacccgggaatccggggtccctgaccgattcagtggcagcggatctgggaccagatttcactctcacntcagcagcctgcaggctgaagatgtggctagtttattactgtcaccaatattataaatactctcagtactttgcctaggggaccaagctggagatacaaacgaactgtaggctgcacatctgtctcatcttccgctac

SEQ ID NO: 399438 - DNA, 500 bp, Homo sapiens
  misc_feature: GZ8MTXP02I17LW.39.17.B06.1.454.CMB.2.raw
tcagtcgcactagtcacgaccggtgctcgatttagtcgatagtgaagggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgtttatacagttccaacaataaaactacttagcttggcaccagcagaaaccaggacagcctcctagagtgctcatttactgggcatctacccgggaatccggggtcctgaccgattcagtggcagcggtctgggacagatttcactctcaccatcagcagccctccaggctgaagatgtggcagtttatactgtcagcaggatattgatagttccgtgacgttcgccaagggaccaaggtggaactacgaaaacgaactgtaggctgcaccatctgtctcactcttccgcactctgtaac

SEQ ID NO: 399439 - DNA, 354 bp, Homo sapiens
  misc_feature: GZ8MTXP02JKNLF.39.17.B06.1.454.CMB.2.raw
  modified_base (347)..(354): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggcgccctgctccaggagcacctccgagagcacagcggccctgggctgcctggtcaaggctacttccactagtgcgactgagcgggctggcaaggcgcatagnnnnnnnn

SEQ ID NO: 399440 - DNA, 586 bp, Homo sapiens
  misc_feature: GZ8MTXP02IUDCR.39.17.B06.1.454.CMB.2.raw
  modified_base (246)..(246): a, c, t, g, unknown or other
  modified_base (289)..(289): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaaccagagtgttttatacagttccaaacaaataaaaaactacttaagcttggnaccagcaagaaaccaggacagcctctagagtgctcatttacgnggcatcgtaccggatccggtcctgactatcagtgcagcgatcgaggacagtattcactctacaacagtcaagacgacgaccgtcgacgacggacgtagaaagtaagtaggtaggtacgttagtttaacgttacttacgtaactaactaaattaaattaaattaaacttaacttacctactacgtacgttacgtaccggaacgggaacgaacgtacgtagagaactaacgaaaacgaaacgtacgtacgacgtacgacaactactaacgtcgtacttactactacctaccgtacctac

SEQ ID NO: 399441 - DNA, 495 bp, Homo sapiens
  misc_feature: GZ8MTXP02FG678.39.17.B06.1.454.CMB.2.raw
  modified_base (357)..(357): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaacaataaaaactacttagcttggcaccagcagaaaccaggacagcctcctagagtgctcatttactgggcatctaccgggaatccggggtcctgaccgattcagtggcagcggatctgggaccagatttcactctcaccntcagcagcctgcaggctgaagatgtggctagttattactgtcaccaatattataaatactctcagtactttggcctaggggaccaagctaggagatacaaaacgactgtagctgcacatctgtactcatctccgctac

SEQ ID NO: 399442 - DNA, 533 bp, Homo sapiens
  misc_feature: GZ8MTXP02I3QRX.39.17.B06.1.454.CMB.2.raw
  modified_base (209)..(209): a, c, t, g, unknown or other
  modified_base (283)..(283): a, c, t, g, unknown or other
  modified_base (359)..(359): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgttttanacagttccaaacaaataaaactacttagcttggcacagcagaaaccaggacagcctctagagtgctcatttacnggcatcacccgggaatccggggtcctgaccgattcgagtggcagcggatcgtgggaccagtatttcactctcaccntcagcagcctgcagctagaagagtgtggactagtttatactgtacactaattattaataactactcctatagtacgtttcggaccgagggtaccaagcgtagaacgactacgaaaacgtacgtgtacgctcgaccacctatcctgttaccttctacttccgttacccgactacg

SEQ ID NO: 399443 - DNA, 349 bp, Homo sapiens
  misc_feature: GZ8MTXP02GBJJL.39.17.B06.1.454.CMB.2.raw
  modified_base (345)..(349): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcggggagttatgtctggggccagggaaccctggccaccgtctcctcagcctccaccaagggcccatcggtcttccccctggcgccctgctccaggagcacctccgagagcacagcggccctgggctgcctggtcaaggctacttccactagtgcgactgagcggctggcaggcgcatagnnnnn

SEQ ID NO: 399444 - DNA, 521 bp, Homo sapiens
  misc_feature: GZ8MTXP02HF4ZY.39.17.B06.1.454.CMB.2.raw
  modified_base (285)..(285): a, c, t, g, unknown or other
  modified_base (359)..(359): a, c, t, g, unknown or other
  modified_base (423)..(423): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgtttatacagttccaaacaaataaaaactacttagcttggcaccagcaagaaaccaggacagcctcctagagtgctcattacnggcatctaccgggaatccggggtccctgaccgattcagtggcagcggatcgtgggaccagatttcactctcacntcagcagcctgcaggctagaagatgtggctagtttatactgacactaatattataactactctntacgtactttggaccgtagggaccaagctaggaagatacgaaaacgtactagtcggactcgacaacctatctcgtccttacacttcccttcccactac

SEQ ID NO: 399445 - DNA, 494 bp, Homo sapiens
  misc_feature: GZ8MTXP02JU5B5.39.17.B06.1.454.CMB.2.raw
  modified_base (208)..(208): a, c, t, g, unknown or other
  modified_base (283)..(283): a, c, t, g, unknown or other
  modified_base (355)..(355): a, c, t, g, unknown or other
  modified_base (392)..(392): a, c, t, g, unknown or other
  modified_base (413)..(413): a, c, t, g, unknown or other
  modified_base (490)..(490): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttanacagttccaacaataaaaactacttagcttggcaccagcagaaaccaggacagcctcctagagtgctcatttacngggcatctaccgggaatccggggtcctgaccgattcagtggcagcgatctgggaccagatttcactctcacntcagcagcctgcaggctgaagatgtgctagttatacngtcacaatatataatactctnagtactttggacctaggggaccaagctggagatacaaacgactgtggctcgcaccatcgtgtcttcactccgttccnctac

SEQ ID NO: 399446 - DNA, 532 bp, Homo sapiens
  misc_feature: GZ8MTXP02IORK7.39.17.B06.1.454.CMB.2.raw
  modified_base (258)..(258): a, c, t, g, unknown or other
  modified_base (285)..(285): a, c, t, g, unknown or other
  modified_base (358)..(358): a, c, t, g, unknown or other
  modified_base (381)..(381): a, c, t, g, unknown or other
  modified_base (384)..(384): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaacaaataaaaactacttagcttggcaccagcaagaaacccnggacagcctcctagagtgctcattacngggcatctacccgggaatccggggtccctgaccgattcagtggcagcgatctggaccagatttcactctcacntcagcacgcctgcaggctagaantgnggctagtttatactgtacactaattattaataatacttcactagtacgtttgaccgaggggtaaccaaggtctaggagactacgaaaacgtaactgtacggctacgacacctataaccgttgttacttctacttcccttccgactacg

SEQ ID NO: 399447 - DNA, 559 bp, Homo sapiens
  misc_feature: GZ8MTXP02IQXF3.39.17.B06.1.454.CMB.2.raw
  modified_base (284)..(284): a, c, t, g, unknown or other
  modified_base (311)..(311): a, c, t, g, unknown or other
  modified_base (349)..(349): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaaacaataaaaactcttagcttggcaccagcagaaaccaggacagccctctagagtgctcatttacgnggcatcgaccggatccggtcctgactntcgagtgcagcgatcgaggacagtattcactctacacntcagcacgcctgacaggctagaagtagtggtgtacgttagtttatacgtacgtaccaactaattaattaattaactacttctactagttacgttcggaccgtaacgggaaccaagtcgtagacgtaacgtaacgaaaacgtacgtggtacggtactacgacctactactcgttcgttaccttactaccgttacccgttacccgacctacg

SEQ ID NO: 399448 - DNA, 503 bp, Homo sapiens
  misc_feature: GZ8MTXP02JEX71.39.17.B06.1.454.CMB.2.raw
  modified_base (362)..(362): a, c, t, g, unknown or other
  modified_base (426)..(426): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctaccggggagtccggggtccctgaccgattcagcggcaggcgggtctggagaccagtatttcactctcaccntcagcagcctgcaggctgaagatggtggctagtttatactgtcagcagtattatagtagtcctnagtcgtttcggcggggacaggctggagatacgaaacgatcgagctcgccacatcgtcgtctcacttcctccgactac

SEQ ID NO: 399449 - DNA, 612 bp, Homo sapiens
  misc_feature: GZ8MTXP02FL5ES.39.17.B06.1.454.CMB.2.raw
  modified_base (208)..(208): a, c, t, g, unknown or other
  modified_base (282)..(282): a, c, t, g, unknown or other
  modified_base (358)..(358): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttanacagttccaacaataaaaactacttagcttggcaccagcagaaaccaggacagcctctagagtgctcatttacngggcatccgtaccgggaatcccggggtcctgaccgtattcagtggcagcgatcgtggaccagtattcactcacacntcagcagcctgccaggctagaaagtagtggtggacttagtttattactgtacaactaattaattaataaatacctcctacacgttacgtttcggaccgtaacgggggaaccctaaggtccgttagggacgaacgttaaccgaaaaacggtaccgttgggtacgggtaccttacggaaccctaacccgttaattccgttttaacggttccctttaccgtaacctttcccccggtttacccccgacctttaaaccg

SEQ ID NO: 399450 - DNA, 625 bp, Homo sapiens
  misc_feature: GZ8MTXP02GBUG3.39.17.B06.1.454.CMB.2.raw
  modified_base (294)..(294): a, c, t, g, unknown or other
  modified_base (386)..(387): a, c, t, g, unknown or other
  modified_base (390)..(390): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgtttatacagttaccaaacaaataaaaactacttaagtcttggcaccagacaagaaaccaggacacgcctaccagagtgctactatttacgnggacattccgtaccccggggaatcccggggtccctggaccgtattcgaggtcggacgagcggatcgtagggaccagtacttcactctacacnncancacgcctgacaggactagaaagagtggtaggacttagtttattacgtgtacaactaattaattaaataaattacctcctactaagttaccgtttacggaccgtaacggggtaaccaaaggtccgtagggtaataacgtaaaccgaaaacggtaccgtagggtacgtaccgtacgaaccgtaaccctattcgttcgttacttacctaacctttccctttacccccgacctttaacg

SEQ ID NO: 399451 - DNA, 558 bp, Homo sapiens
  misc_feature: GZ8MTXP02FPJKD.39.17.B06.1.454.CMB.2.raw
  modified_base (288)..(288): a, c, t, g, unknown or other
  modified_base (372)..(372): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgaggagggccaccatcaactgcaagtccaaccagagttgttttaatacagttaccaaacaaataaaaactacttagcttggcaccagcaagaaaccaggacagcctcagatgctcatttacgngggcatccgtaccggggaactcccggggtcctgaccgtattcaggtcgcgaggcgatcgtaggggaccagtattcactcacacntcagcagcctgcgagctagaagatggtgtactagttattactgtacaactaatattaataactactctactagttacgtttacggacgaagggacctaacgcgtagagtaactaacgaaaacgtacgtgtacggctacgacctactacttcgtacgttacttactaccttccgtacccgtactacg

SEQ ID NO: 399452 - DNA, 353 bp, Homo sapiens
  misc_feature: GZ8MTXP02G4F1K.39.17.B06.1.454.CMB.2.raw
  modified_base (260)..(260): a, c, t, g, unknown or other
  modified_base (348)..(353): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcgggtagttatgtctggggccaggggaaccctggccaccgtctcctcagcctccaccaagggcccatcggtcttcccctggcgcctgctccaggncactccgagagcacagcggccctgggctgcctggtcaaggcctacttccactagtgcgaactgagcggggctggcaaggcgacatagnnnnnn

SEQ ID NO: 399453 - DNA, 585 bp, Homo sapiens
  misc_feature: GZ8MTXP02JW50P.39.17.B06.1.454.CMB.2.raw
  modified_base (290)..(290): a, c, t, g, unknown or other
  modified_base (384)..(384): a, c, t, g, unknown or other
  modified_base (415)..(415): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgcaagtccaaccagagttgttttatacagttccaaacaaataaaactacttagcttggcaccagcaagaaacccaggacagcctcctaagagtgctcatttacgngggcatccgtaacccgggatccccggggtcctgacccgtattccgagtcggcaggcggtatcgtagggacccagtatttccactctaccacctntccaagccagccctgactagggctagaaagngtgtcggacttagtttacttacgtcgtacaacctaattaatttaataaacttactcctatacgttactttcggaccgtaagggaccaagcgtaggagtactacgaaaacgacgtgtacggactcgaccaccgtatcgttacgtctttaccacttcccttacccgactacc

SEQ ID NO: 399454 - DNA, 585 bp, Homo sapiens
  misc_feature: GZ8MTXP02HCEWW.39.17.B06.1.454.CMB.2.raw
  modified_base (211)..(211): a, c, t, g, unknown or other
  modified_base (275)..(275): a, c, t, g, unknown or other
  modified_base (287)..(287): a, c, t, g, unknown or other
  modified_base (380)..(380): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgaggagggccaccagtcaactgacaagtccaaccagagtgttttanacagttccaacaataaaactcttagcttggcaccagcagaaaccaggacagcctcctagagtcnctactattacgnggactacgtaccgtaccgggacgtcccgggtcctagaccgtatcgaggtcggacgaggcgtatcggtaggacctagtacttacactctacacngtcacgacgacgctcgcgacgacgtagagtagtagtagtacgtagttacttacgtactactaactaataattaactaactactactacgtacgttacgttacgtacggaacggacgacgtacgtagtagaacgtaacgaaacgtaacgtacggtacgtacgtacgactactactcgtcgttacttactactacctacctactacg

SEQ ID NO: 399455 - DNA, 509 bp, Homo sapiens
  misc_feature: GZ8MTXP02HZLD4.39.17.B06.1.454.CMB.2.raw
  modified_base (208)..(208): a, c, t, g, unknown or other
  modified_base (285)..(285): a, c, t, g, unknown or other
  modified_base (365)..(365): a, c, t, g, unknown or other
  modified_base (389)..(389): a, c, t, g, unknown or other
  modified_base (424)..(424): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttanacagttccaaacaaataaaaactacttagcttggcaccagcagaaaccaggacagcctcctagagtgctcatttacnggcatctacccgggaatcccggggtccctgaccgattcagtggcagcggatcgtgggaccagtactttcacttctcaccntcagcagcctgcagctgaagatgngctagtttatactgtcacaatattataatactctnagtactttgccgagggaccaagctagagatacaaaacgaactgaggtactcgaccaccgatcgtcgtactcattccttccgctac

SEQ ID NO: 399456 - DNA, 529 bp, Homo sapiens
  misc_feature: GZ8MTXP02G7TZN.39.17.B06.1.454.CMB.2.raw
  modified_base (209)..(209): a, c, t, g, unknown or other
  modified_base (288)..(288): a, c, t, g, unknown or other
  modified_base (367)..(367): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgttttanacagttaccaaacaaataaaaactacttagcttggcaccagcaagaaaccaggacagcctacctagagtgctcattacngggcatcctacccggggaatcccggggtccctgaccgattcagtggcagcgatcgtgggaccagtatttcactctcacntcagcagcctgcaggctagaagatgtggctagtttatactgtacactaattattataatactactacagtactttcggaccgtagggaccagacgtaggagacgtacgaaacgtactgtacggactcgacacctatcgtcgtacttcactcctcccgactac

SEQ ID NO: 399457 - DNA, 359 bp, Homo sapiens
  misc_feature: GZ8MTXP02GZOC7.39.17.B06.1.454.CMB.2.raw
  modified_base (244)..(244): a, c, t, g, unknown or other
  modified_base (248)..(248): a, c, t, g, unknown or other
  modified_base (261)..(261): a, c, t, g, unknown or other
  modified_base (272)..(272): a, c, t, g, unknown or other
  modified_base (276)..(276): a, c, t, g, unknown or other
  modified_base (349)..(359): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaaccggccctctatgggtcgggtagttatgtctggggccagggaaccctggccaccgtctcctcagcctccaccaagggcccatcggtccttccccnggcnccctgctccaggncactccgagancacngcgccctggctgcctggtcaaggctacttccatagtcgcgactggaggcgggctgggacaagggcgcagtagnnnnnnnnnnn

SEQ ID NO: 399458 - DNA, 682 bp, Homo sapiens
  misc_feature: GZ8MTXP02JP3XV.39.17.B06.1.454.CMB.2.raw
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagacctccctggctgtgtctctgggcgagagggccaccatcaactgcaagtccaaccagagttgttttatacagttccaaacaaattaaaaactacttagcttggcaccagcaagaaaccaggacagccctcctagagtgctcatttacgtgggctatacccgtaccggggaacgtcccggggtccctaggaccgtattcgaggtcggacacggcggtatcggtagggacctagttactttacgactctaccaccctatccgaagtccgacgcctaggccagggtacctagaaagtagtggtcggtacttaagtttacttacgtcgtaccaacctaaattaattacttaaactaccttacctactacgttaccgtttcggaccggtaacggggtaaccaacggttaccgagggtaaacgtaacgttaaaccgaaaaccggttaacgttacgggtacggttaccgttacgaaccctaaccgttaacttcgttaacgtttccttaccgttaaccgttcccctttacccccggtaactttaaccg

SEQ ID NO: 399459 - DNA, 512 bp, Homo sapiens
  misc_feature: GZ8MTXP02IGG4E.39.17.B06.1.454.CMB.2.raw
  modified_base (208)..(208): a, c, t, g, unknown or other
  modified_base (282)..(282): a, c, t, g, unknown or other
  modified_base (365)..(365): a, c, t, g, unknown or other
  modified_base (474)..(474): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgtttanacagttccaaacaataaaactcttagcttggcaccagcagaaaccaggacagcctcctagatgctcatttacgnggcatccgtacccgggaatcccggggtccctggacccgtattcagtggcagcgatcgtgggaccagtatttcactctacaccntcagcagcctgcagctagaagatgtgctagtttatactgtacactaattattataatactctacagtactttagccgagggaccaagcgtagagatacgaaacgactgngctcgaccactactctcgtcttacactccgtccactac

SEQ ID NO: 399460 - DNA, 503 bp, Homo sapiens
  misc_feature: GZ8MTXP02F14VF.39.17.B06.1.454.CMB.2.raw
  modified_base (282)..(282): a, c, t, g, unknown or other
  modified_base (360)..(360): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaacaataaaaactacttagcttggcaccagcagaaaccaggacagcctctagagtgctcatttacngggcatctacccgggaatcccggggtcctgaccgattcgagtggcagcgatcgtgggaccagtatttcactctcactntcagcagcctgcagctgagatgtgctagttattactgtcacaatattataatactctcagtactttcgcagggaccaagcagagactacgaaacgaactcgtcgtactcgacacactcgtcgtactctactccttcccgctac

SEQ ID NO: 399461 - DNA, 558 bp, Homo sapiens
  misc_feature: GZ8MTXP02JZODC.39.17.B06.1.454.CMB.2.raw
  modified_base (208)..(208): a, c, t, g, unknown or other
  modified_base (286)..(286): a, c, t, g, unknown or other
  modified_base (368)..(368): a, c, t, g, unknown or other
  modified_base (442)..(442): a, c, t, g, unknown or other
  modified_base (487)..(487): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccatactccctggctgtgtctctgggcgagagggccaccatcaactgcaagtccaaccagagtgttttanacagttccaaacaaataaaaactacttagcttggcaccagcaagaaaccaggacagcctctagagtgctcatttacgngggcagtccgtaccggggaatccggggtccctgaccgtattcagtgcagcgatcgtgggacccagtatttcactctacaccntcagcagcctgcaggctagaagatggtggctagtttatactcgtacacctaaattattaataaactactcctanacgttaacgtttcgaccggtaacggggtaaccaagccgtaggganaactaacgaaaacgtacgtagtacggactacgaccaaccgatctcgtacttcactcccttccgaccttacg

SEQ ID NO: 399462 - DNA, 353 bp, Homo sapiens
  misc_feature: GZ8MTXP02HNLYI.39.17.B06.1.454.CMB.2.raw
  modified_base (271)..(271): a, c, t, g, unknown or other
  modified_base (345)..(353): a, c, t, g, unknown or other
tcagtcgcactagtcacgaccggtgctcgatttagtcgatagtgaagggccgattcaccatctccagagacaattccaagagcacactctatttgcaaatgaacagcctgggagctgaggacacggctgtctattactgtgcgaaagaccggccctctagtgggtcgggagttatgtctggggccagggaaccctggccaccgtctcctcagcctccaccaaggcccatcggtcttcccctggccgcctgctccaggagcacctccgagcncacagccggccctggctgcctggtcaaggctacttccactagtgcgactgagcgggctggcaaggcgcagtagnnnnnnnnn

SEQ ID NO: 399463 - DNA, 637 bp, Homo sapiens
  misc_feature: GZ8MTXP02GL9HF.39.17.B06.1.454.CMB.2.raw
  modified_base (210)..(210): a, c, t, g, unknown or other
  modified_base (379)..(379): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagagggccaccatcaactgcaagtccaaccagagttgttttanacagttaccaaacaaataaaaactacttagcttggcaccagcagaaaccaggacagcctctagagtgctctattacgtgggcagtccgtacccggggaatccccggggtccctagacccgtattcgaggtggcaggcgatcgtagggaccagtatttcactctaccacntcgagccagtccctgcgaggctagaaagtgttaggtaggtacttaagtttacttacgttacgtacaacctaattaattaaattaaacttaccttaccttactacgttaccgttttacggacccgtaacggggtaaccaacggtaccgtagggaacgtaacgtaacgtaaaacgtacgtaggtacggtacctacggtaccctaccgtacttccgttacgttaccttacctaccgtttcccttaccccgtaccttaaccg

SEQ ID NO: 399464 - DNA, 566 bp, Homo sapiens
  misc_feature: GZ8MTXP02IZ6DW.39.17.B06.1.454.CMB.2.raw
  modified_base (289)..(289): a, c, t, g, unknown or other
  modified_base (371)..(371): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccatactccctggctgtgtctctgggcgagagggccaccatcaactgacaagtccaaccagagtgttttatacagttaccaaacaaataaaaactacttagcttggcacagacaagaaaccaggacagcctcctagatgctctatttacgngggcagtcctaccccggggaatcccggggtccctgaccgtattcgagtggcagcgatcgtggacagtatttcactctcaccntcagcacgctgcgaggctagagagtgtgactagtttatactgtaccactaaacttattaactaacttaccttactactagttactttcgccgtaaggggaccctaaaggtcgtaggaagtactaacaaaacgtagtcggtacggacctagaccacctatccgttacgtaccttacactttccctaccgcttaacg

SEQ ID NO: 399465 - DNA, 575 bp, Homo sapiens
  misc_feature: GZ8MTXP02IRICD.39.17.B06.1.454.CMB.2.raw
  modified_base (209)..(209): a, c, t, g, unknown or other
  modified_base (282)..(282): a, c, t, g, unknown or other
  modified_base (332)..(332): a, c, t, g, unknown or other
  modified_base (341)..(341): a, c, t, g, unknown or other
  modified_base (352)..(352): a, c, t, g, unknown or other
  modified_base (371)..(371): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagttgttttanacagttccaacaataaaaactcttagcttgcaccagcaagaaaccaggacacgcctcagagtgctcatttacngggcactccgtaccgggaactcccggggtccctgaccgtattcagtggcnggcgatcgngggacccagtntttcacttctaccaaccgntcaacgcacgccctgacgaggactagaagtacgtggtgtacgtagttttacttacgtagtaccaaacctaattaactttaattaaactactctactagttaccgtttacggacgtacggggaacacgtcgtagagactaacaaacgtacgtggtacgacgtcgactacctattctacgttcttactacttccttcccgactacg

SEQ ID NO: 399466 - DNA, 530 bp, Homo sapiens
  misc_feature: GZ8MTXP02F0GHM.39.17.B06.1.454.CMB.2.raw
  modified_base (284)..(284): a, c, t, g, unknown or other
  modified_base (360)..(360): a, c, t, g, unknown or other
  modified_base (470)..(470): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccaaccagagtgttttatacagttccaaacaaataaaaactacttagcttggcaccagcagaaaccaggacagcctctagagtgctctattacngggcatctacccggggaatcccggggtcctgaccgattcgagtgcagcgatcgtggaccagtattcactctacacntcagcagcctgcaggctagaaagagtgtaggtactagtttacttacgtgtacaactaaattattaataactacttcctacagttactttcggaccgtacgggacaacgtntacgagactacgaaaacgatcgtagctcgacactatcgtgtctactactcctaccgctac

SEQ ID NO: 399467 - DNA, 627 bp, Homo sapiens
  misc_feature: GZ8MTXP02JD5VL.39.17.B06.1.454.CMB.2.raw
  modified_base (210)..(210): a, c, t, g, unknown or other
  modified_base (295)..(295): a, c, t, g, unknown or other
  modified_base (379)..(379): a, c, t, g, unknown or other
  modified_base (407)..(407): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctctgggcgagacgggccaccatcaactgcaagtccaaccagagttgttttanactagttaccaaacaaataaaaactacttaagcttggcaccagcaagaaaccaggacagccctactagagtcgctctactttacnggctatccgaccgggtacgtcccgggtccctgaccgtattcgaggtcgcgagcgatcgtaggacctagtacttcactctcaccntcagcacgcctgacgaggctaggaaagngtggtaggtacttagtttacttactcgtaccaactaattaaatttactaaagttacccttacgtactacggtttaaccgtttccgggaaccggtaaccggggtaccaaagtccggtagaacgtaaacttaaccgaaaacgttacgtcggttacggactacggaccctaacgtaacttcttacggttacccttactccgtttaccctcccgactttaaccg

SEQ ID NO: 399468 - DNA, 593 bp, Homo sapiens
  misc_feature: GZ8MTXP02JLRKE.39.17.B06.1.454.CMB.2.raw
  modified_base (214)..(214): a, c, t, g, unknown or other
  modified_base (227)..(227): a, c, t, g, unknown or other
  modified_base (297)..(297): a, c, t, g, unknown or other
  modified_base (397)..(397): a, c, t, g, unknown or other
  modified_base (521)..(521): a, c, t, g, unknown or other
  modified_base (532)..(532): a, c, t, g, unknown or other
tcagtcgcactagtcacgaccggtgctcgatttagtcgatagtgaaggggcagcaagatggtgttgcagacccaggtcttcatttctctgttgctctggatctctggtgccgaacggggacatcgtgatcgacccagtctccagactccctggctgtgtctcgtgggcgaggagggccaccatcaactgacaagtaccaacagagttagtttanacagttaccaaanaaactaaaactacttagcttaggcaccagacaacgaaaccaggacacgcctcagatgctactatttacgnggactacgtccgtaccgggtaacgtcccggggacctacgaccgtatacggtagtcggacaggcggtatccgtaggacctagtactttccaacttcacacntacgagtccacgcctgacacggactagaagtagtggtacgtacttaagtttacttactacgtacaaactaattaattaactaactactactatacgtagttacgacgaggtacgagacgtaganatacgaaacgngtacgtgactacgactacgtactaacgtcgtaccttccgtacccgtacctacctacgtacg

SEQ ID NO: 399469 - DNA, 692 bp, Homo sapiens
  misc_feature: GZ8MTXP02HE1OX.39.17.B06.1.454.CMB.2.raw
  modified_base (215)..(215): a, c, t, g, unknown or other
  modified_base (483)..(483): a, c, t, g, unknown or other
  modified_base (663)..(663): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatcgacccagtctccagacctccctggctgtgtctcgtgggcgagacgggccaccatcaactgacaagtccaacagtagttgttttaanactagttaccaaactaaattaaaaacttacttagcttaggaccaccgaagacaacgaaaacccgaggtaaccaacggccctacctaaggacgtcgactaccgtatttaccggtcgggtactaacttcccggttaaaccccggggaaaccggtttccccgggggtacccccttaggaaccccggttaatttccgaacgggttcggaccgacgggccggtaatcggggtaggggaaccctagttactttacgacctcctaccaacccgtnttaaccgagtaccgacgtcccgtagaccggtacggtacgtaaggaaacgtgtagggtacgtcgttaagttttactacgtatacccaataattaactattaactaccttcagtacgttacgttcgaacggacggtacgagtcgagataactacgaaaacgtgtcgacggtatcgactactntcgtgtccttcgaccttcctcccgatacg

SEQ ID NO: 399470 - DNA, 606 bp, Homo sapiens
  misc_feature: GZ8MTXP02IV37J.39.17.B06.1.454.CMB.2.raw
  modified_base (208)..(208): a, c, t, g, unknown or other
  modified_base (220)..(220): a, c, t, g, unknown or other
  modified_base (269)..(269): a, c, t, g, unknown or other
  modified_base (284)..(284): a, c, t, g, unknown or other
  modified_base (384)..(384): a, c, t, g, unknown or other
  modified_base (538)..(538): a, c, t, g, unknown or other
  modified_base (557)..(557): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacgggggacatcgtgatgacccagtctccagactccctggctgtgtctctgggcgagagggccaccatcaactgcaagtccaacagagttgtttanacagttccaaanaaataaaaatcttagcttggcacagcaagaaaccaggacagcctctagngtcgctcaatttcgngggactacgtccgaacccgggtaagtcccggggtaccctaggaccgtattccgagtcggacagcggtatcgtcgggacagttacttacactcctcaaccnttcgacgtcaccgccgtacgcgttacgggctaggaaagtagtaggtaggacgttatttacttactacggttaacaaccttaaattaattaactaaaacttaccttacctacgtaaggtttacgttcggtaccgacgggtacctaagcagggtanaactaaacgaaacggtacnggtacgctacgactacctagtctcgtcttacacttccctaccgactacg

SEQ ID NO: 399471 - DNA, 614 bp, Homo sapiens
  misc_feature: GZ8MTXP02I1FRV.39.17.B06.1.454.CMB.2.raw
  modified_base (207)..(207): a, c, t, g, unknown or other
  modified_base (213)..(213): a, c, t, g, unknown or other
  modified_base (417)..(417): a, c, t, g, unknown or other
tcagtcgcactagtcacgaccggtgctcgatttagtcgatagtgaaggggcagcaagatggtgttgcagacccaggtcttcatttctctgttgctctggatctctggtgccaacggggacatcgtgatgacccagtctccagactccctggctgtgtctcgtgggcgagacgggccaccatccaactgacaagtccaaccagagttnttttanacagttaccaaacaaataaaaactacttaagcttggacacagacaacgaaaccaggacagccctctagagtgctactattacgtgggaccataccgtacccggggtaatccccgggggtaccctaggaccgtattccgagtcggactaggcggatcggtagggaccctagtactttcgacttctacaaccctgtcaagccgacnccgtgacaggcagaagtagtggtaggtagttagtttactactacgtaacaactaaattaattaacttaactactctacgtacgttacgttacggacgtacgggacaacggcgtagagtactaaacgtaaacgtagtcggtagtcgtacgactacgtacttaacgttacgttctacttccttaccgttccctactacg

SEQ ID NO: 399472 - DNA, 480 bp, Homo sapiens
  misc_feature: GZ8MTXP01D2TMN.15.41.D08.1.454.CMB.2.raw
  modified_base (438)..(438): a, c, t, g, unknown or other
  modified_base (445)..(446): a, c, t, g, unknown or other
  modified_base (448)..(480): a, c, t, g, unknown or other
tcagtctacgtagccacgaccggtgctcgatttagtcacgcgagaaagggaaggggctggagtgggtctcatccattagtagtggtagtgatttcagatactacgcagactcagtgaagggcccgatttaccgtctccagagacaacaccaagaactcactctttctccacatgaacagcctgagagccgacgacacggctgtttattactgtgcgagagacaacgaggttcttagtcttgagacggctactgtttttgacttacttgactactggggccagggaactctggtctccgtctcctcagcctcaccaggcccatcgtcttccccctggccaccctcctccaagcgcacctcctgggggcacgagccggccctgggctgccctgggtcaagggactactccgctacgtagactgagcgggctggcaaggcncatacgnngnnnnnnnnnnnnnnnnnnnnnnnnnnnnnnnnn

SEQ ID NO: 399473 - DNA, 501 bp, Homo sapiens
  misc_feature: GZ8MTXP01B5XSB.15.41.D08.1.454.CMB.2.raw
  modified_base (488)..(489): a, c, t, g, unknown or other
  modified_base (491)..(501): a, c, t, g, unknown or other
tcagtctacgtagccacgaccggtgctcgatttagtcacgcgagaaagggaaaggggctggagtgggtctcatccattagtagtggtagtgatttcagatactacgcagactcagtgaagggccgatttaccgtctccagagacaacaccaagaactcactctttctccacatgaacagcctgagagccgacgacacggctgtttattactgtgcgagagacaacgtaggttcttagtcttgagacggctactagtttttgacttacttgactacgtgggccagggactctggtctccgtctcctcacgccctccaccgacggcccactccggtccttcccccgtggccctacccctcctaccaacgacgcctacctccggtcgggggcacgacggccggcccgtgggcctcgccgtggtacaagggtacctacgtcccgctacgtagacgtggacggcggggcgtcgggacgaacgggcgcagtagnngnnnnnnnnnnn

SEQ ID NO: 399474 - DNA, 446 bp, Homo sapiens
  misc_feature: GZ8MTXP02HG3SG.15.41.D08.1.454.CMB.2.raw
  modified_base (443)..(446): a, c, t, g, unknown or other
tcagtctacgtagccacgaccggtgctcgatttagtcacgcgagaaagggaaagggactggagtgggtctcatccattagtagtggtagtgatttcagatactacgcagactcagtgaagggccgatttaccgtctccagagacaacaccaagaactcactctttctccacatgaacagcctgagagccgacgacacggctgtttattactgtgcgagagacaacgaggttcttagtcttgagacggctacagtttttgactactttgactactggggccaggggaactctggtctccgtctcctcagcctccaccaagggcccatcggcttccccctggcaccctcctccaagagcacctcctgggggcacagcgccctgggctgcctggtcaagggctacttccgctacgtagactgagcgggctggcaaggcgcgatagnnnn

SEQ ID NO: 399475 - DNA, 442 bp, Homo sapiens
  misc_feature: GZ8MTXP02IH5F4.15.41.D08.1.454.CMB.2.raw
  modified_base (433)..(433): a, c, t, g, unknown or other
  modified_base (435)..(435): a, c, t, g, unknown or other
  modified_base (438)..(442): a, c, t, g, unknown or other
tcagtctacgtagccacgaccggtgctcgatttagtcacgcgagaaagggaaaggggctggagtgggtctcatccattagtagtggtagtgatttcagatactacgcagactcagtgaagggccgatttaccgtctccagagacaacaccaagaactcactctttctccacatgaacagcctgagagccgacgacacggctgtttattactgtgcgagagacaacgaggttcttagtcttgagacggctactagtttttgactactttgactactggggcccagggaactctggtctccgtctcctcagcctccaccaaggcccatcggtcttccccctggcaccctcctccaagagcactcctggggcacagcgccctgggctgcctggtccaaggctacttcccgctacgctgagcggcgtgacgaagcananagnnnnn

SEQ ID NO: 399476 - DNA, 498 bp, Homo sapiens
  misc_feature: GZ8MTXP02IJT96.15.41.D08.1.454.CMB.2.raw
  modified_base (481)..(498): a, c, t, g, unknown or other
tcagtctacgtagccacgaccggtgctcgatttagtcacgcgagaaagggaaaggggctggagtgggtctcatccattagtagtggtagtgatttcagatactacgcagactcagtgaagggccgatttaccgtctccagagacaacaccaagaactcactctttctccacatgaacagcctgagagccgacgacacggctgtttattactgtgcgagagacaacgaggttcttagtcttgagacggctactagtttttgacttactttgactactgggcagggaactctgtctccgtctcctcacgcctccaccaacgggccccagtccggtcctttcccccgtggcccacccctccctcccaaagacgccaccttcccgtgggggccacacggccggcccctggggcctcgcctcggtccgaacgggtactaccttcccgctacgtacgacgtgacgcgggcgtggcaaggcgcatagnnnnnnnnnnnnnnnnnn

SEQ ID NO: 399477 - DNA, 425 bp, Homo sapiens
  misc_feature: GZ8MTXP01EURM7.19.86.H09.1.454.CMB.2.raw
  modified_base (422)..(425): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggccccatcggtcttccccctggcgccctgctccaggagcacctccgagagcacagccggccctggggctgccctggtcaaggactacttcccacgagagtactgagcgggctgggcaaggcgcatagnnnn

SEQ ID NO: 399478 - DNA, 554 bp, Homo sapiens
  misc_feature: GZ8MTXP01EVZFC.19.86.H09.1.454.CMB.2.raw
  modified_base (196)..(196): a, c, t, g, unknown or other
  modified_base (359)..(359): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacgccntgtattatgtgcgaggcgagggacgggactaaaggcaagtaaagtggtaccgacccgtggggccagggaacctggtcaccggtctctcacgccctccaccacggcccacgtccggtcccttccccgtcggccgccccttcgccttccgacggacgccgcccttccgaagacgcacgcggccggcccgttgggccg

SEQ ID NO: 399479 - DNA, 522 bp, Homo sapiens
  misc_feature: GZ8MTXP01DIF5K.19.86.H09.1.454.CMB.2.raw
  modified_base (343)..(343): a, c, t, g, unknown or other
  modified_base (363)..(363): a, c, t, g, unknown or other
  modified_base (407)..(407): a, c, t, g, unknown or other
  modified_base (461)..(461): a, c, t, g, unknown or other
tcagtactctcgtgcacgaccggtgctcgatttagtgctatagacttgggtttgggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtgcgcatacgtcgcacagaagtttcaggccgngtcaccatggccaagggtcncgtccacgaatacagtgtatatggacttgagcagcctgaggtcngacgacacggccatgtattatgtgcgaggcaggcggggctaaaggcaataaagnggttcgacccgtggggccagggaacccttggtcaccgtctccgtcacgccttccgaacccg

SEQ ID NO: 399480 - DNA, 451 bp, Homo sapiens
  misc_feature: GZ8MTXP01D65R0.19.86.H09.1.454.CMB.2.raw
  modified_base (448)..(451): a, c, t, g, unknown or other
tcagtactctcgtgcacgaccggtgctcgatttagtgctatagacttgggtttggggccgttcctgggactttctgataccacatcacaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaaagtcagccccaaggctgcccctcggtcactctgttcccaccctcctccacgagagtactgagcgggctgggcaaggcgcatagnnnn

SEQ ID NO: 399481 - DNA, 559 bp, Homo sapiens
  misc_feature: GZ8MTXP01BKAQV.19.86.H09.1.454.CMB.2.raw
  modified_base (519)..(519): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccaatgtattattgtgcgaggcaggacggggctaaaggcaataaagtggttacgaccccgtggggccagggaaccctggtcaccgggtctcctcacgcctccaccaacgggcccacgtccggtccttccccctggccgccccgttcgccttcccgaggcgccnccttccgaagacggccacgacgccggtcccgttcgggccg

SEQ ID NO: 399482 - DNA, 378 bp, Homo sapiens
  misc_feature: GZ8MTXP01BDICH.19.86.H09.1.454.CMB.2.raw
  modified_base (376)..(378): a, c, t, g, unknown or other
tcagtactctcgtgcacgaccggtgctcgatttagtgctatagacttgggtttgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtcggtttcggcggaggaccaagctgaccgtcctaagtcagcccaaggctgcccctggtcactctcgttcccaccctcctccacgagacgtactgagcgggctgggcaaggcgcatagnnn

SEQ ID NO: 399483 - DNA, 517 bp, Homo sapiens
  misc_feature: GZ8MTXP01CK38Q.19.86.H09.1.454.CMB.2.raw
  modified_base (493)..(493): a, c, t, g, unknown or other
  modified_base (510)..(517): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtacccaggaacggccccaaacctacgtcatctataatgacgctgagcggtccttaagggtcctgacgattctctggcgagaggtctggcgcctcagcttccctggccatcagagggctccagtctgaagatgaggctgattattactgtcgcaatctgggatgacaagtgtaggaacgggttccggttttcgggacggacggggaaccaagctggaacccgtctaagtcacgccccaaaggcctcgacccccctggtcacctcgttccgttcccacccctctccacgagagtacctgagccggntcggcaaggcgcatagnnnnnnnn

SEQ ID NO: 399484 - DNA, 596 bp, Homo sapiens
  misc_feature: GZ8MTXP01A3JHW.19.86.H09.1.454.CMB.2.raw
  modified_base (359)..(359): a, c, t, g, unknown or other
  modified_base (572)..(572): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccntgtattatttgcgaggcagggacggggacgtaaaggacgaagtaaagttgggttaccggaccccgttcgggggcccgacggggaacccgtcggtccgacccgtcgttcccgtcacgaccctcccgaacccgaacgggcccacgtccggttccgttcccccgttcgggcccgccccgtcgccgtcccgacggacgccacccgttccgacgcgcncacggccggcccgtcgggcgtccg

SEQ ID NO: 399485 - DNA, 480 bp, Homo sapiens
  misc_feature: GZ8MTXP01ELJ9X.19.86.H09.1.454.CMB.2.raw
  modified_base (347)..(347): a, c, t, g, unknown or other
  modified_base (450)..(450): a, c, t, g, unknown or other
  modified_base (464)..(464): a, c, t, g, unknown or other
  modified_base (470)..(470): a, c, t, g, unknown or other
  modified_base (475)..(480): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggccctgaccgattctctggcgagaggtctggcgctcagctcctggccatcagagggctccagtctgaagatgaggctgattattactgtgcaatctgggatgacngtgtgaacggttcggtttcggcggagggtaccaagctgaccgtctaagtcagcccaaggcctggccccctggtcacttctcgttccccacctcctccacgagngtactgagcggcgngcgagngcagnnnnnn

SEQ ID NO: 399486 - DNA, 591 bp, Homo sapiens
  misc_feature: GZ8MTXP01B8L2N.19.86.H09.1.454.CMB.2.raw
  modified_base (579)..(579): a, c, t, g, unknown or other
  modified_base (581)..(591): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattctctggcgagaggtctggcgcctcagcttccctggccatcagagggctccagtctgaagatgagctgattattactgtcgcaatcgtggggattgactggtgtagggtaaaccgggttcccgggttttcgggacggggtaacgggacccgaaagtcgtacggaacccgttccgtaaaggttcgaaggccgacgaaacggcctccgccccccgtcgggtcctaccgttccgttccggttcccccgtccccttccccttcccgaaccggacgtacggttacctggaacggccgggcgtgggaccaaacgggccggcagtaggngnnnnnnnnnnn

SEQ ID NO: 399487 - DNA, 496 bp, Homo sapiens
  misc_feature: GZ8MTXP01BGJ5L.19.86.H09.1.454.CMB.2.raw
  modified_base (352)..(352): a, c, t, g, unknown or other
  modified_base (473)..(473): a, c, t, g, unknown or other
  modified_base (489)..(496): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagaggggctcagtctgaagatgaggctgattattactgtcgcaatctggatgacngtgtgaacgggtcggttttcggcggtagggacccaagctgaccgtctaagtcagcccaaggctcgcccctcggtcactcgtcgttccccgccctcctccacgacgagtactgagcgggtcnggcaaggcgcagtagnnnnnnnn

SEQ ID NO: 399488 - DNA, 489 bp, Homo sapiens
  misc_feature: GZ8MTXP01B4XJ8.19.86.H09.1.454.CMB.2.raw
  modified_base (348)..(348): a, c, t, g, unknown or other
  modified_base (480)..(480): a, c, t, g, unknown or other
  modified_base (485)..(489): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagcttccctggccatcagagggctcagtctgaagatgagctgattattactgtgcaatctggatgacngtgtgaacggtccggtttcggcgggagggacccaagctgaccgtcctaagtcagcccaaggctcgcccctcggtcacctcgtcgttccccacccttcctccgacgacgagtactgagcggctggcaagggcncgagnnnnn

SEQ ID NO: 399489 - DNA, 499 bp, Homo sapiens
  misc_feature: GZ8MTXP01ATC2P.19.86.H09.1.454.CMB.2.raw
  modified_base (259)..(259): a, c, t, g, unknown or other
  modified_base (351)..(351): a, c, t, g, unknown or other
  modified_base (456)..(456): a, c, t, g, unknown or other
  modified_base (489)..(499): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattcnctggcgagaggtctggcgcctcagcttccctggccatcagagggctccagtctgaagatgaggctgattatactgtcgcaatctggatgacngtgtgaacggttccggtttcggcggagggaccagctcgacgtctaagtcacgcccaaggcctcgcccctcggtcacctcgttcgtccccgccctcctccacgagngtacctgacgcgggctggcaaggcgcagtacgnnnnnnnnnnn

SEQ ID NO: 399490 - DNA, 522 bp, Homo sapiens
  misc_feature: GZ8MTXP01DXRLX.19.86.H09.1.454.CMB.2.raw
  modified_base (368)..(368): a, c, t, g, unknown or other
  modified_base (467)..(467): a, c, t, g, unknown or other
tcagtactctcgtgcacgaccggtgctcgatttagtgctatagacttgggtttgggggaagaggaagactgacggccccactcccaggtgcagctggtgaagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgcgcacagaagttcagggccgcgtcaccatggccaaggtcgcgtccacgaatacagtgtatatggacttgagcagcctgacggtctgacgacacggccatgtattatgtncgaggcaggacgggctaaaggcataaagtggttacgacccgtgggccagggaaccctggtcaccgtctcctcagcctccacaacggccatcgtctcccngccgcctgctccaggacgcaccgttccgagaagcaacgcgcggccctgggctcgg

SEQ ID NO: 399491 - DNA, 504 bp, Homo sapiens
  misc_feature: GZ8MTXP01AYD0B.19.86.H09.1.454.CMB.2.raw
  modified_base (254)..(254): a, c, t, g, unknown or other
  modified_base (258)..(258): a, c, t, g, unknown or other
  modified_base (352)..(352): a, c, t, g, unknown or other
  modified_base (474)..(474): a, c, t, g, unknown or other
  modified_base (487)..(487): a, c, t, g, unknown or other
  modified_base (492)..(504): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgcccccaaatcgtcatctataatgacgctgagcggtcttaagggtccctgaccgnttcnctggcgagaggtctggcgcctcagcttccctggccatcagagggctccagtctgaagatgaggctgattattactgtcgcaatctgggatgacngtgtgaacggtcggtttcggcggagggaccaagctgaccgtctaagtcacgccaaggctcgcccctcggtcacctcgtacgttccccaccctcctccacgacgacgtacctgacggcgggcngggcaaggccganagagnnnnnnnnnnnnn

SEQ ID NO: 399492 - DNA, 563 bp, Homo sapiens
  misc_feature: GZ8MTXP01BORLG.19.86.H09.1.454.CMB.2.raw
  modified_base (289)..(289): a, c, t, g, unknown or other
  modified_base (293)..(293): a, c, t, g, unknown or other
  modified_base (550)..(550): a, c, t, g, unknown or other
  modified_base (552)..(561): a, c, t, g, unknown or other
  modified_base (563)..(563): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtcttaagggtccctgaccgattctctggcgagaggtctggcgctcagcttcccgngcancagaggctcagtcagagatgacgctagtaattattactgtcgactaagtcgtaggatagacgtgtgtacggtaaccgggtttccgggtttacgggacgggaagggaacccaagtcgtacggtaccgtacgtaagtcgacgcgacgacggctcccgccccgtcgtcctaccgttccgttcccgttccccgcccctcctacccgacgtacgtaacgtacgtcggacggccgggcgtcggacgacggacgacgacgtagngnnnnnnnnnngn

SEQ ID NO: 399493 - DNA, 486 bp, Homo sapiens
  misc_feature: GZ8MTXP01CTHGP.19.86.H09.1.454.CMB.2.raw
  modified_base (259)..(259): a, c, t, g, unknown or other
  modified_base (351)..(351): a, c, t, g, unknown or other
  modified_base (482)..(486): a, c, t, g, unknown or other
tcagtactctcgtgcacgaccggtgctcgatttagtgctatagacttgggttttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattcnctggcgagaggtctggcgcctcagcttccctggccatcagagggctccagtctgagatgaggctgattattactgtgcaatctgggatgacngtgtgaacgggtcggtttcggcggagggaccaagctgaccgtctaagtcagcccaaggctgccccctggtcactcgtcgttccccgccctcctccacgcgagtactgagcgggctggcaaggcgcagtagnnnnn

SEQ ID NO: 399494 - DNA, 496 bp, Homo sapiens
  misc_feature: GZ8MTXP01D5V3G.19.86.H09.1.454.CMB.2.raw
  modified_base (352)..(352): a, c, t, g, unknown or other
  modified_base (490)..(496): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctcagtctgaagatgaggctgattattactgtcgcaatctgggatgacngtgtgaacgggttccggtttcggcgggagggaccaagctgaccgtctaagtcagcgcaaggctcgcccctcggtccacgtctcgttccccaccctcctccgacgagacgtactgacgcgggctggcaaggcgcatagnnnnnnn

SEQ ID NO: 399495 - DNA, 532 bp, Homo sapiens
  misc_feature: GZ8MTXP01DZV34.19.86.H09.1.454.CMB.2.raw
  modified_base (349)..(349): a, c, t, g, unknown or other
tcagtactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgttgctgggcttgtgatctacgttgcaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccncgtcaccatcggccaaggtcgcgtccacgaatacagtgtatatggactgagcagcctgaggtctagacgacacggccatgtattattgtgcgaggacgagggacgggctaaagggcaataaagttggttccgacccgtggggccagggcccttggtcacgtctccgtcacgccttccgaaccg

SEQ ID NO: 399496 - DNA, 548 bp, Homo sapiens
  misc_feature: GZ8MTXP01D5SLA.19.86.H09.1.454.CMB.2.raw
  modified_base (362)..(362): a, c, t, g, unknown or other
  modified_base (497)..(497): a, c, t, g, unknown or other
  modified_base (513)..(513): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtgggtggcgcatacgtcgcacagaagttcagggccgcgtcaccatggccaaggtcgcgtccacgaatacagtgtatatggacttgagcagcctgaggtctgacgacaacggccntgtattatgtgcgaggcaggacgggactaaaggcaagtaaagtggttcgacccgtggggccacgggaacctggtcaccgggtctcctcacgcctccaccgaacggcccatccggtccttcccccgtggccgcccncgccttccgaggcgcnccttccgaagacgcacgacgccggcccttgggccg

SEQ ID NO: 399497 - DNA, 554 bp, Homo sapiens
  misc_feature: GZ8MTXP01DCK38.19.86.H09.1.454.CMB.2.raw
tcagtactctcgtgcacgaccggtgctcgatttagtgctatagacttgggtttggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggcccaaggtcgcgtccacgaatacagtgtatatggacttgagcagcctgaggtctgacgacaacggccaatgtattattgtgcgaggcaggacggggactaaagggcaagtaaagtggttacgaccccgtggggccgagggaaccctggtcaccgggtctccgtcacgccctccaccaagggcccatccgtccttccccctggccgcccttggccttccgacggacgcgccttcccgaagacgcacagccggcccgttgggccg

SEQ ID NO: 399498 - DNA, 546 bp, Homo sapiens
  misc_feature: GZ8MTXP01CWVN1.19.86.H09.1.454.CMB.2.raw
  modified_base (195)..(195): a, c, t, g, unknown or other
  modified_base (512)..(512): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccaggtggtagtggtggcgcatacgtcgcacagaagttcagggccgcgtcaccatggccaaggtcgcgtccacgaatacagtgtatatggacttgagcagcctgaggtctgacgacaacgggccaatgtattatgtgcgagcaggacgggctaaagggcaataaagtggttacgaccccgtggggccaggggaaccctggtccacggtctcctcacgccctccaccgacggcccagtccggtcctcccctggccgcccttgccttccgaggcgccnccttccgaagacgcacacggccgcccgttgggcc

SEQ ID NO: 399499 - DNA, 527 bp, Homo sapiens
  misc_feature: GZ8MTXP01C4GAF.19.86.H09.1.454.CMB.2.raw
  modified_base (468)..(468): a, c, t, g, unknown or other
  modified_base (518)..(527): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgtattctctggcgagaggtctggcgcctcagcttccctggccatcagagggctccagtctgagatgaggctgattatactgtgctaatctggggatgactggtgtaggtaacgggttccgggtttcgggcggtaggggaccaagctggaccgtctaagtcagcccaaggtcctacgcccctcggtctaccttcgttcgttccccaccccttccncctaaccgagtacgtacctggagccgggcgtggcgaacgggcacgatagnnnnnnnnnn

SEQ ID NO: 399500 - DNA, 495 bp, Homo sapiens
  misc_feature: GZ8MTXP01CZXKS.19.86.H09.1.454.CMB.2.raw
  modified_base (352)..(352): a, c, t, g, unknown or other
  modified_base (483)..(483): a, c, t, g, unknown or other
  modified_base (490)..(495): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacngtgtggaaacgggttcgggtttcggcgggagggaccaagctgaccgtctaagtcagcccaaggctcgcccctcggtcactctcgttcccaccctcctccacgagacgtacctgacgcgggctggcaaggcncgatagnnnnnn

SEQ ID NO: 399501 - DNA, 490 bp, Homo sapiens
  misc_feature: GZ8MTXP01AOAB9.19.86.H09.1.454.CMB.2.raw
  modified_base (259)..(259): a, c, t, g, unknown or other
  modified_base (482)..(490): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattcnctggcgagaggtctggcgcctcagcttccctggccatcagagggctcagtctgagatgaggctgattattactgtgcaatctggggatgacaagtgtgaacggtcggtttggcggagggaccagctgaccgtctaagtcagcccaaggctcgccccctggtcactctcgttcccgccctcctccacgagacgtactggacgcggctggccaaggcgcagtagnnnnnnnnn

SEQ ID NO: 399502 - DNA, 513 bp, Homo sapiens
  misc_feature: GZ8MTXP01ESQEG.19.86.H09.1.454.CMB.2.raw
  modified_base (470)..(470): a, c, t, g, unknown or other
  modified_base (473)..(473): a, c, t, g, unknown or other
  modified_base (483)..(483): a, c, t, g, unknown or other
  modified_base (486)..(486): a, c, t, g, unknown or other
  modified_base (488)..(488): a, c, t, g, unknown or other
  modified_base (496)..(496): a, c, t, g, unknown or other
  modified_base (501)..(501): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccaatgtattatgtgcgaggcaggacggggactaaaggcaataaagtggttcgaccccgtggggccagggaacctgtcacggtctctcagcctccacaggcccatcgtctcccngcnccttgcttcngcncncttcgaangcacngcgccgttgggc

SEQ ID NO: 399503 - DNA, 580 bp, Homo sapiens
  misc_feature: GZ8MTXP01D3XOW.19.86.H09.1.454.CMB.2.raw
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccntgtattattgtgcgagggcagggacggggactaaagggcaagtaaagtgggttccgacccgtggggccagggaaccctggtccaccgggtctcctcacgccctccaccgaacgggccccacgtccggtcccttcccccgtgggcccgtccccttcggccttccgacgggacgccgacccttccggaagacggccaacgcggccgggccccgttcggggccg

SEQ ID NO: 399504 - DNA, 552 bp, Homo sapiens
  misc_feature: GZ8MTXP01BP10X.19.86.H09.1.454.CMB.2.raw
  modified_base (513)..(513): a, c, t, g, unknown or other
  modified_base (532)..(532): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacgggccaatgtattattgtgcgaggcagggacggggctaaaggcataaagtggttcgacccgtggggccagggaaccctgtccacgggtctcctcacgcctccaccgaacgggcccagtccggtccttccccctggccgcccttgccttccgaggcgccnccgttccgaagacgcaacncggccggcccgttcgggccg

SEQ ID NO: 399505 - DNA, 540 bp, Homo sapiens
  misc_feature: GZ8MTXP01D2XJM.19.86.H09.1.454.CMB.2.raw
  modified_base (429)..(429): a, c, t, g, unknown or other
  modified_base (487)..(487): a, c, t, g, unknown or other
  modified_base (509)..(509): a, c, t, g, unknown or other
  modified_base (517)..(517): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcagggccgcgtcaccatggccaaggtcgcgtccacgaatacagtgtatatggacttgagcagcctgaggtctgacgacaacggccaatgtattattgtgcgaggcaggacgggctaaaggcataaagtggttcgaccctggggccagggaacccngtcaccggtctccgtcacgcctccaccaaagggccccatccggtcttccccctggccncccttgccttcccgaggacgcnccttccgnacgcacagcggcccgttggggcc

SEQ ID NO: 399506 - DNA, 502 bp, Homo sapiens
  misc_feature: GZ8MTXP01E0EAO.19.86.H09.1.454.CMB.2.raw
  modified_base (353)..(353): a, c, t, g, unknown or other
  modified_base (492)..(502): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacngtgtgaacgggtcggttttcggcggagggaccaagctgaccgtctaagtcacgcccaaggctcgccccctcggtccactcgtcgttccccgcccctcctccgacgacgagtactgacgcgggctggcaaggcgcagagnnnnnnnnnnn

SEQ ID NO: 399507 - DNA, 521 bp, Homo sapiens
  misc_feature: GZ8MTXP01CRBPU.19.86.H09.1.454.CMB.2.raw
  modified_base (164)..(164): a, c, t, g, unknown or other
  modified_base (282)..(282): a, c, t, g, unknown or other
  modified_base (511)..(521): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgctttgttctgcaagcagctcgaacatcgggancagtggtgtgatgtggtatcagaaagtcccaggaaccgcccccaaatcgtcatctaataatgacgctgagcggtccttaagggtccctgaccgtattctcgtggcgagaggtctggcncctcagcttccctggccatcagagggctccagtctagaagatgaggctgattattactgtcgcaatcgtggatgactgtgtggaacgggttccgggtttcgggcgggaggaccaagctgaccgtctaagtcagcccaagctcgcccctggtcactcgtcgttccccaccctcctccacgacgacgtaactggacggccgggtctcgggcgaaacggcggaccagtaagnnnnnnnnnnn

SEQ ID NO: 399508 - DNA, 552 bp, Homo sapiens
  misc_feature: GZ8MTXP01DPMFV.19.86.H09.1.454.CMB.2.raw
  modified_base (357)..(357): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtgatagggcgatccaggtggtagtggtggcgcatacgtcgcacagaagttcagggccgcgtcaccatggccaaggtcgcgtccacgaatacagtgtatatggacttgagcagcctgaggtctgacgacaacggcntgtattattgtgcgaggcagggacgggctaaaggcagtaaagtggttcgaccccgtggggccacgggaaccctggtccaccgggtctcctcacgcctccaccgaacgggcccacgtccggtccttccccgtggccgcccttcgccttccgaggacgccgccttccgaagacgcacgacgccggccgttcgggccg

SEQ ID NO: 399509 - DNA, 496 bp, Homo sapiens
  misc_feature: GZ8MTXP01AOYX3.19.86.H09.1.454.CMB.2.raw
  modified_base (163)..(163): a, c, t, g, unknown or other
  modified_base (313)..(313): a, c, t, g, unknown or other
  modified_base (347)..(347): a, c, t, g, unknown or other
  modified_base (447)..(447): a, c, t, g, unknown or other
  modified_base (484)..(496): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtgtatcagaagtcccaggaaccgccccaaatcgtcatctataatgacgctgagcgtccttaagggtccctgaccgtattctctggcgagaggtctggcgcctcagcttccctggccatcagagggctcagtctgagntgaggctgattatactgtgcaatcgtggatgacngtgtagtaacggtccggtttcggcggtagggaccaagctgaccgtctaagtcacgccaaggctcgcccctcggcactcgtcgtcccaccctcctccacgngacgtactgacgcgggtctggcgaacggcgcagtagnnnnnnnnnnnnn

SEQ ID NO: 399510 - DNA, 530 bp, Homo sapiens
  misc_feature: GZ8MTXP01DG95D.19.86.H09.1.454.CMB.2.raw
  modified_base (484)..(484): a, c, t, g, unknown or other
  modified_base (488)..(488): a, c, t, g, unknown or other
  modified_base (501)..(501): a, c, t, g, unknown or other
  modified_base (514)..(514): a, c, t, g, unknown or other
  modified_base (524)..(524): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacgggcaatgtattattgtgcgagggcagggacggggactaaaggcagtaaagtggttcgacccgtgggccagggacccgtgtcaccggtctcctcacgcctccacacggcccatccggtctccccgtgccncccngccttcgagcgcnccttcgaagcgcncacgcgccgnggtccg

SEQ ID NO: 399511 - DNA, 552 bp, Homo sapiens
  misc_feature: GZ8MTXP01B1GKI.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgacgtggatagggcgatccacggtggtagtggtggcgcatacgtcgcacagaagttcagggccgcgtcaccatggccaaggtcgcgtccacgaatacagtgtatatggacttgagcagcctgaggtctgacgacacggccaatgtattatgtgcgaggcaggacgggctaaagggcataaagtggttcgaccctggggccagggaaccctggtcaccgggtctcctcacgcctccaccaaacggggcccagtccggtccttcccccgtggcccgcccttcggccttccgacggacgcaccttcccgaagcgcacagccggcccgttggggccg

SEQ ID NO: 399512 - DNA, 574 bp, Homo sapiens
  misc_feature: GZ8MTXP01E1H2B.19.86.H09.1.454.CMB.2.raw
  modified_base (363)..(363): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagttcagggccgcgtcaccatggccaaggtcgcgtccacgaatacagtgtatatggacttgagcagcctgaggtctgacgacaacgggccnttgtattattgtgcgaggcgagggacgggctaaaggcaagtaaagtggttccgaccccgtggggaccacgggaaccctggtccaccgggtctcccgtcacgccctccgaccgacgggcccagtccggtcccttcccccgtcggccgcccttgccttccgaggacgccgcccgttcccgaagacgccacgacggccgtcccgttgggtcccg

SEQ ID NO: 399513 - DNA, 382 bp, Homo sapiens
  misc_feature: GZ8MTXP01DDTI4.19.86.H09.1.454.CMB.2.raw
  modified_base (379)..(382): a, c, t, g, unknown or other
tcagtactctcgtgcacgaccggtgctcgatttagtgctatagacttgggtttgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtcctaagtcagcccaagcctcgccccctggtcactctcgtccccacctcctccacgagacgtactgacgcggctggcaaggcgcatagnnnn

SEQ ID NO: 399514 - DNA, 535 bp, Homo sapiens
  misc_feature: GZ8MTXP01BLHPW.19.86.H09.1.454.CMB.2.raw
  modified_base (504)..(504): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcagggccgcgtcaccatggccaaggtcgcgtccacgaatacagtgtatatggacttgagcagcctgaggtctgacgacaacggcaatgtattatgtgcgaggcaggacgggctaaagggcataaagtggttcgaccctggggccagggaaccctggtcacggtctcctcacgcctccaccaacgggcccatccggtcttcccctggccgcccttgccttccgaggacgcnccttccgaagacgcacagcgccgttgggccg

SEQ ID NO: 399515 - DNA, 543 bp, Homo sapiens
  misc_feature: GZ8MTXP01BIV1Z.19.86.H09.1.454.CMB.2.raw
  modified_base (359)..(359): a, c, t, g, unknown or other
  modified_base (509)..(509): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccntgtattattgtgcgagcaggacgggactaaaggcaagtaaagtaggttcgacccgtggggccgacgggaaccctggtcaccgggtctcctcacgcctccaccgaacggcccatccgtcctcccctggcccgcccttgccttccgagcgcnccttccgaagcgcacgacgcggcccgttgggccg

SEQ ID NO: 399516 - DNA, 560 bp, Homo sapiens
  misc_feature: GZ8MTXP01AF33E.19.86.H09.1.454.CMB.2.raw
  modified_base (521)..(521): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccaatgtattattggtgcgagggcagggacgggactaaaggcaagtaaagtggttcgaccccgtggggccgacgggaaccctggtcaccgggtctcctcacgccctccaccgaacgggcccacgtccggtcctccccgtggccgcccttgccttccgaggcgccnccgttccgaagcggccacacggccggcccgttgggcccg

SEQ ID NO: 399517 - DNA, 668 bp, Homo sapiens
  misc_feature: GZ8MTXP01BL6HL.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcgcggcgtcacacagcgacgtacggcgccgtacgaacgtaactacgagttagtataggtacggttacgtagacgacgacgtcgtaggtacgtcgtacgaccgaccggaaccgactgtagttatttagtgtcgacgggaggacggacggggacggtaaacggtaacgacgtaaagtacgggttacgggtaccccggtaccgggtccgggaccggaaacccgggtaccggtacggtaccccgtaccggggttcccttaccgtaccgacccgtccccgacccgaaccggacccggacctaccggtccgttcccccgtcccggcggccccgtccgcgtcccacggacgccgacccgttccgcgaacgccgaacgaccgcggcccggtccggcggtccg

SEQ ID NO: 399518 - DNA, 509 bp, Homo sapiens
  misc_feature: GZ8MTXP01EHVKH.19.86.H09.1.454.CMB.2.raw
  modified_base (501)..(501): a, c, t, g, unknown or other
tcagtactctcgtgcacgaccggtgctcgatttagtgctatagacttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctggtaccaacatcacccaaataaagcccccaaactcatcatttatgatgccactaagcggccctcagggtttctaatcgcttcctctggctccaagtctggcaacacggcctccctgacaatctctgggctccagctgaggacgaggctgattactatgctgctcatatgctaggtctatctcttatgtcttcggactgggaccaagggtccaccggttcttaggtcagcccaagcccaaccctnttgtaacc

SEQ ID NO: 399519 - DNA, 512 bp, Homo sapiens
  misc_feature: GZ8MTXP01C2EQX.19.86.H09.1.454.CMB.2.raw
  modified_base (163)..(163): a, c, t, g, unknown or other
  modified_base (256)..(256): a, c, t, g, unknown or other
  modified_base (352)..(352): a, c, t, g, unknown or other
  modified_base (477)..(477): a, c, t, g, unknown or other
  modified_base (497)..(497): a, c, t, g, unknown or other
  modified_base (500)..(500): a, c, t, g, unknown or other
  modified_base (502)..(512): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcgtcttaagggccctgaccgattcnctggcgagaggtctggcgcctcagcttccctggccatcagagggctccagtctgaagatgaggctgattattactgtcgcaatcgtggggatgacngtgtgtaacgggttcggttttcgggcggtagggaccaagctgaccgtctaagtcagcgcaaggctcgcccctggtccacgtcctcgttccccaccctcctccacgagtacgtcctgacgccgggngtcggcgaaaggccacgtanagngnnnnnnnnnnn

SEQ ID NO: 399520 - DNA, 621 bp, Homo sapiens
  misc_feature: GZ8MTXP01AVJ1J.19.86.H09.1.454.CMB.2.raw
  modified_base (364)..(364): a, c, t, g, unknown or other
tcagtactctcgtgcacgaccggtgctcgatttagtgctatagacttgggtttggggggaagaggaagactgacggccccactcccaggtgcatctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatcggccaaggtcgcgtccacgaatacagtgtatatggacttgagcagcctggaggtctgacgacaacgggccntgtattagttgtgcgaggcgagggacgggacgtaaagggcaagtaaaggtcgggttaccgaccccgtgggggacccgaacggggtaaccccgtgggtcccgacccggggttctcccgttccacgtccctacccgacccgaacgggccccacgttcccgggtccccttcccccgtgggcccgtccccgttcgcccttccgacgggcgcccgcccgttccggaagacgccacgacggcccgggtcccgttggggtcccg

SEQ ID NO: 399521 - DNA, 493 bp, Homo sapiens
  misc_feature: GZ8MTXP01BYHEO.19.86.H09.1.454.CMB.2.raw
  modified_base (352)..(352): a, c, t, g, unknown or other
  modified_base (418)..(418): a, c, t, g, unknown or other
  modified_base (486)..(486): a, c, t, g, unknown or other
  modified_base (489)..(493): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacgggtccggttttcgggcggtagggaccaagctggaccgtcctaagtcagcccaaggcngcccctcggtcacgtctcgttccccaccctcctccacgagacgtactgagcgggctggcaaggcgcanagnnnnn

SEQ ID NO: 399522 - DNA, 548 bp, Homo sapiens
  misc_feature: GZ8MTXP01CLCK7.19.86.H09.1.454.CMB.2.raw
  modified_base (195)..(195): a, c, t, g, unknown or other
  modified_base (515)..(515): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtgatagggcgatccgaggtggtagtggtgcgcatacgtcgcacagaagttcaggccgcgtcaccatcggccaaggtcgcgtcacgaatacagtgtatatggacttgagcagcagtgaggtctgacaacacggccatgtattatgtgcgaggcaggacgggactaaaggctaagtaaagtgggttaccgaccccgtggggacccaacgggaaccctgggtccgaccgtcctccctacacgccctccaccgaacggccctagtccgtcctccccgtggcccgccctgcctaccgngggaccgcaccgcgacgcgcacgcgccgcgtcg

SEQ ID NO: 399523 - DNA, 543 bp, Homo sapiens
  misc_feature: GZ8MTXP01DY5W3.19.86.H09.1.454.CMB.2.raw
  modified_base (358)..(358): a, c, t, g, unknown or other
  modified_base (492)..(492): a, c, t, g, unknown or other
  modified_base (511)..(511): a, c, t, g, unknown or other
  modified_base (524)..(524): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagttcagggccgcgtcaccatggccaaggtcgcgtccacgaatacagtgtatatggacttgagcagcctgaggtctgacgacaacggccntgtattattgtgcgaggcagggacggggactaaaggcaagtaaagtggttcgaccccgtggggccagggaaccctggtcaccgggtctccgtcacgcctccaccaacgggcccatccggtccttcccctggccncccttgccttccgacggcncgccttccgaagngcacagcgcccgttgggcc

SEQ ID NO: 399524 - DNA, 546 bp, Homo sapiens
  misc_feature: GZ8MTXP01DM2XZ.19.86.H09.1.454.CMB.2.raw
  modified_base (333)..(333): a, c, t, g, unknown or other
  modified_base (390)..(390): a, c, t, g, unknown or other
  modified_base (482)..(482): a, c, t, g, unknown or other
  modified_base (489)..(489): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccaggtgtagtggtgcgcatacgtcgcacagaagttcagggccgcgtcaccagtcggccaaggtcgcgtccacgatacagtgtatatggacttgancagcctgaggtctgacgactaacggccaagtgtattatgtgcgagggcaggacgggntaaagcataaagtggttcgaccgtgggccaggacctgtcaccggtctcctcacgcctcccaccgacgggacccagtccggtccttcccccgngggcccnccttgccttccgaggacgcgaccgttcgaagcgcacacggccgtcccgttgggcccg

SEQ ID NO: 399525 - DNA, 589 bp, Homo sapiens
  misc_feature: GZ8MTXP01BYZ5U.19.86.H09.1.454.CMB.2.raw
  modified_base (196)..(196): a, c, t, g, unknown or other
  modified_base (361)..(361): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacaacggccntgtattattgtgcgaggcgagggacgggactaaaggcaagtaaagtcggtcgaccccgtggggaccgacgggaaccctggtccgaccggtctcccgtcacgccctccgaccgacgggcccctacgtcccggtcccttcccccgtcgggcccgccccgttggcccttccgacggaccgcccgacccgttccggaagacgccgacgacggccggtccccgttgggtcccg

SEQ ID NO: 399526 - DNA, 569 bp, Homo sapiens
  misc_feature: GZ8MTXP01CD99N.19.86.H09.1.454.CMB.2.raw
  modified_base (281)..(281): a, c, t, g, unknown or other
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacagaagttcagggccncgtcaccatcggccaaggtcgcgtccacgaatacagtgtatatggacttgagcagcctgaggtctgacgacaaccggcntgtattattgtgcgaggcgagggacgggacgtaaaggcaagtaaagtcggttccgaccccgtggggaccgacgggaaccctggtccaccggttctcctcacgcctcccgaccgacgggcccagtccggtccttcccccgtggcccgcccttcgcccttccgacggcgcccgccttccgaagacgcacgacggccggtcccgttgggccg

SEQ ID NO: 399527 - DNA, 570 bp, Homo sapiens
  misc_feature: GZ8MTXP01ARSMB.19.86.H09.1.454.CMB.2.raw
  modified_base (361)..(361): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacaacgggccntgtattattgtgcgaggcagggacggggctaaaggcaagtaaagtggttccgaccccgtggggccgagggaaccctggtccaccggtctcctcacgccctccaccgaacgggcccacgttccgggtccttcccccgtgggcccgcccgttcggcccttccgaggacgccgacccgttccgaagcgcacgacggccggcccgttggggcc

SEQ ID NO: 399528 - DNA, 507 bp, Homo sapiens
  misc_feature: GZ8MTXP01AZ8WL.19.86.H09.1.454.CMB.2.raw
  modified_base (355)..(355): a, c, t, g, unknown or other
  modified_base (466)..(466): a, c, t, g, unknown or other
  modified_base (495)..(495): a, c, t, g, unknown or other
  modified_base (500)..(507): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgtattctctggcgagaggtctggcgcctcagcttccctggccatcagagggctccagtctgaagatgaggctgattattactgtcgcaatcgtgggatgacngtgtgtaacgggttcggtttcgggcggagggacccaagctagaccgtactagtcacgcccaaggcctcgcccctcggtcacgtcgtcgttcccgcccctcctccacgacgngtacctgaggcgggctgggcaaggcgacngtagnnnnnnnn

SEQ ID NO: 399529 - DNA, 498 bp, Homo sapiens
  misc_feature: GZ8MTXP01D32FU.19.86.H09.1.454.CMB.2.raw
  modified_base (164)..(164): a, c, t, g, unknown or other
  modified_base (229)..(229): a, c, t, g, unknown or other
  modified_base (355)..(355): a, c, t, g, unknown or other
  modified_base (481)..(481): a, c, t, g, unknown or other
  modified_base (484)..(484): a, c, t, g, unknown or other
  modified_base (486)..(498): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcggggancagtggtgtgatgtggtatcagaaagtcccaggaaccggccccaaactcgtcatctataatgacnctgagcggtccttaagggtccctgaccgattctctggcgagaggtctggcgcctcagcttccctggccatcagagggctcagtctgaagatgagctgatttatactgtcgcaatcgtgggatgacngtgtaggaacgggttcggtttcgggcgggagggaccagctagaccgtctagtcagccagctcgcccctgcactctcgttcccaccctcctccacgcgagtaccgtgacgcggctggcaaggccganagngnnnnnnnnnnnnn

SEQ ID NO: 399530 - DNA, 569 bp, Homo sapiens
  misc_feature: GZ8MTXP01DLUH6.19.86.H09.1.454.CMB.2.raw
  modified_base (302)..(302): a, c, t, g, unknown or other
  modified_base (358)..(358): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcncgtccacgaatacagtgtatatggacttgagcagcctgaggtctgacgacacggcntgtattattgtgcgaggcaggacgggactaaaggcagtaaaagtggttaccgacccgtggggccacgggaccctggtccacgggtctcctcacgccctccgaccgaacgggcccctacgtccggttcccttcccccgtcgggccctccccgttggcccttccgacggacgccgccgttccgaagacgcacacgccggtcccgttgggtccg

SEQ ID NO: 399531 - DNA, 731 bp, Homo sapiens
  misc_feature: GZ8MTXP01D1CK6.19.86.H09.1.454.CMB.2.raw
  modified_base (676)..(676): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacgacggcccctggacgaagggtcttaggagtggagtagggcgactccgaggtggtaggtgggtggcgcagtacgtcgcacagtaagttcgagggccgcgtcaccagtcggaccgaaggtcgcgtaccaacgaatacagtgtatagtggacttgagcagccgtaggaggtctacggacgaccgaaccgggacctaagttgttaatttagtttggtcggacgggagggtacgaacgggggacggggtaacgtaaagggactaaaggttaaacggttcgggttacccggtaccccgggtacggggacccgaaaccggggtaacccgttacgggtacccgtaacccgggggttcccttacccgttaccgaaccggtccccttaccccgaaacccgaaccggggtacccctaaccgttcccgggttcccctttcccccggcgggccccgtccccgttcggtcccgttccgaacgggtaccncccgttacccgaccggaacgacgccgaccgacgggcccggtcccgttgggtcccg

SEQ ID NO: 399532 - DNA, 579 bp, Homo sapiens
  misc_feature: GZ8MTXP01D0M5Q.19.86.H09.1.454.CMB.2.raw
  modified_base (346)..(346): a, c, t, g, unknown or other
  modified_base (359)..(359): a, c, t, g, unknown or other
  modified_base (537)..(537): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgagtntgacgacacggcngtgtattatgtgcgaggcgagggacgggactaaaggcaagtaaaggttggttaccgaccccgtgggggaccgacggggaaccctggtaccaccgggtctcctcgacgccctcccaccgaacggcccactccggttccttcccccgtgggcccgccccgttcgccttccgacggcgccnccgttccgaagacgccaacgcggcccggccgttcggggtccg

SEQ ID NO: 399533 - DNA, 559 bp, Homo sapiens
  misc_feature: GZ8MTXP01CR86D.19.86.H09.1.454.CMB.2.raw
  modified_base (232)..(232): a, c, t, g, unknown or other
  modified_base (272)..(272): a, c, t, g, unknown or other
  modified_base (364)..(364): a, c, t, g, unknown or other
  modified_base (464)..(464): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccncgtcaccatggccaaggtcgcgtccacgaatacagtgtanatggacttgagcagcctgaggtctgacgacacggccatgtattattgtgcgaggcaggacggggcctaaaggcataaagtggttacgacccngtggggccaggggaaccctggccaccgtctcctcacgcctccaccaacgggcccagtccggtccttcccccgtcgcccgccctcgccgtcccgagggacnccacctcccgagacgccacgacgccggcccgtgggctcgcctggcgaagggcttaccgttcccacggaagagtcctgacggcgggcgttggaacg

SEQ ID NO: 399534 - DNA, 561 bp, Homo sapiens
  misc_feature: GZ8MTXP01EJAQQ.19.86.H09.1.454.CMB.2.raw
  modified_base (282)..(282): a, c, t, g, unknown or other
  modified_base (359)..(359): a, c, t, g, unknown or other
  modified_base (521)..(521): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcagggccncgtcaccatggccaaggtcgcgtccacgaatcagtgtatatggacttgagcagcctgaggtctgacgacaacggccntgtattattgtgcggaggcagggacggggactaaagggcaataaagtggttcgacccgtggggccagggaaccctggtcaccggtctcctcacgcctccaccgaacgggcccatccggtccttcccccgtggccgtcccgttcgccttccgacggaacgccncccgcccgaagcgccacgcggcccggcccgttggggcccg

SEQ ID NO: 399535 - DNA, 620 bp, Homo sapiens
  misc_feature: GZ8MTXP01EQ9N4.19.86.H09.1.454.CMB.2.raw
  modified_base (355)..(355): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgagtctgacgacgacgcntgtattattgtgcggaggcgagggacggggacgtaaaggactaagtaaaggttcggttacccggaccccggtcggggacccgaacggggtacccgtacgggtacccgtaccggggtcctccctaccgacgcccctacccgaacccgaaccggggccctaacgttccggttcccttcccccgtcggcccgtccccgttggcccttccgacgggcgccgacccgttccgaacgcgaaccgacgacggcccggtcccgttcgggcccg

SEQ ID NO: 399536 - DNA, 477 bp, Homo sapiens
  misc_feature: GZ8MTXP01CKFAB.19.86.H09.1.454.CMB.2.raw
  modified_base (258)..(258): a, c, t, g, unknown or other
  modified_base (350)..(350): a, c, t, g, unknown or other
  modified_base (444)..(444): a, c, t, g, unknown or other
  modified_base (467)..(467): a, c, t, g, unknown or other
  modified_base (473)..(477): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattcnctggcgagaggtctggcgctcagcttccctggccatcagagggctccagtctgaagatgaggctgattattactgtcgcaatctggatgacngtgtgaacgggtcggtttcggcgggacggacagctgacgtctaagtcagcccagctcgcccctggtcactcgtcgttcccgccctcctccacgngagtactgagcggctggcaggcncatagnnnnn

SEQ ID NO: 399537 - DNA, 571 bp, Homo sapiens
  misc_feature: GZ8MTXP01D4YRQ.19.86.H09.1.454.CMB.2.raw
  modified_base (362)..(362): a, c, t, g, unknown or other
  modified_base (530)..(530): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacaacggccntgtattagttgtgcgagggcagggacggggctaaagggcaagtaaaggttcggttaccgaccccgtggggccgacgggaaccctggtccaccgggtctcctcacgccctccaccgacggcccagtccggtcccttccccgtggcctcccttcgccttccgaggcgccnccgttccgaagacgccaacgcggccggtcccgttgggcccg

SEQ ID NO: 399538 - DNA, 506 bp, Homo sapiens
  misc_feature: GZ8MTXP01EZT5W.19.86.H09.1.454.CMB.2.raw
  modified_base (163)..(163): a, c, t, g, unknown or other
  modified_base (260)..(260): a, c, t, g, unknown or other
  modified_base (467)..(467): a, c, t, g, unknown or other
  modified_base (477)..(477): a, c, t, g, unknown or other
  modified_base (500)..(506): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcggtccttaagggtccctgaccgattctntggcgagaggtctggcgcctcagcttccctggccatcagagggctccagtctgaagatgaggctgattattactgtcgcaatcgtgggatagactgtgtaggaacggtcgggttttcggcgggagggacccaagctggaccgtcctaagtctagcccgaaggcctcgccccctcggtcacctcgtcgttccccaccctcctccacgngacgtactgngcgggctggcgaagcgcagtagnnnnnnn

SEQ ID NO: 399539 - DNA, 549 bp, Homo sapiens
  misc_feature: GZ8MTXP01BPYXR.19.86.H09.1.454.CMB.2.raw
  modified_base (513)..(513): a, c, t, g, unknown or other
  modified_base (521)..(521): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtggtggtggcgcatacgtcgcacagaagttcagggccgcgtcaccatggccaaggtcgcgtccagaatacagtgtatatggacttgagcagcctgaggtctgacgacaacggccaatgtattattgtgcgaggcagggacgggctaaaggcaataaaggtggttcgaccccgtggggccacgggaacccgtggtccaccggtctccgtcacgcctccacgaaggcccagtccggtcctcccctggccgcccttggccttccgaggacnccgacccnccgaagacgcacgcggccgccgttcggc

SEQ ID NO: 399540 - DNA, 561 bp, Homo sapiens
  misc_feature: GZ8MTXP01BPZOK.19.86.H09.1.454.CMB.2.raw
  modified_base (523)..(523): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcagggccgcgtcaccatggccaaggtcgcgtccacgaatacagtgtatatggacttgagcagcctgaggtctgacgacacgggccaatgtattattgtgcgaggcagggacggggctaaaggcaataaaggtggttcgacccctgggggccaggggaaccctggtcaccggtctcctcacgcctcccaccaacgggcccagtccggtccttcccccgtgggcccgcccttcgccttccgacggacgccnccgttccgaagacgcacgcgccggtcccgttggggccg

SEQ ID NO: 399541 - DNA, 558 bp, Homo sapiens
  misc_feature: GZ8MTXP01CS1Q7.19.86.H09.1.454.CMB.2.raw
  modified_base (197)..(197): a, c, t, g, unknown or other
  modified_base (363)..(363): a, c, t, g, unknown or other
  modified_base (374)..(374): a, c, t, g, unknown or other
  modified_base (515)..(515): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtncgacaggcccctggacaagggcttgagtggatagggcgatccgagggtggtagtggtggcgcatacgtcgcacagaagttcagggccgcgtcaccatcggccaaggtcgcgtccaacgaatacagtgtatatggacttgagcagcctgaggtctgacgacacggcntgtattattgngcgaggcgagggacgggacaaaggcaagtaaagtggttccgacccgtggggccacgggacctggtcaccgggtctccgtcacgccctccaccgacggcccagtccgtcctccccgtcgccgtcccttgcccttcgacggcnccgcccttccgaagcgcacgacggccggtcccgttcgggtccg

SEQ ID NO: 399542 - DNA, 515 bp, Homo sapiens
  misc_feature: GZ8MTXP01ETXL1.19.86.H09.1.454.CMB.2.raw
  modified_base (429)..(429): a, c, t, g, unknown or other
tcagtactctcgtgcacgaccggtgctcgatttagtgctatagacttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctggtaccaacatcaaccaaataaacgcccccaaactcatcatttatgatgaccactaagcgccctcgtagggtttctaatcgcttcctctggctcaagtctgcaacacggcctcctgacatctcgtggctccgagctggaaggacgaggctgattactactgctgctcatatnctaggtctatcttcttatgtctttcggacgtggaaccaggtcaccgttcttagggcacgcccaacgcccaaccctcgttcgtaacc

SEQ ID NO: 399543 - DNA, 728 bp, Homo sapiens
  misc_feature: GZ8MTXP01C51MB.19.86.H09.1.454.CMB.2.raw
  modified_base (227)..(227): a, c, t, g, unknown or other
  modified_base (316)..(316): a, c, t, g, unknown or other
  modified_base (710)..(710): a, c, t, g, unknown or other
  modified_base (716)..(716): a, c, t, g, unknown or other
  modified_base (720)..(720): a, c, t, g, unknown or other
  modified_base (725)..(725): a, c, t, g, unknown or other
  modified_base (727)..(727): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgntgagcggtccttaagggccctgaccattctctggcgagaggtctggcgcctcagcttccctggccatcagacgggctccagtctgaagntgagctgattattactgtcgacatcgtggggattaggactggttggttacgggtaaaccgggtttcccggggttttacggggcggggtaacggggacccgaaaggtccgttacggtaaccccggttacccgttaaacggttcccgaaacgggtacccccgaaacggggtcccgttacccgggtcccccccccgttcggggttacccctaaccccgtttcccgggtttaccccggtttcccccccggtccccctttacccccggttaccccgtaacccgggaacggtaaccggttaaacccggttcggggtaaacccggggtcccgggggaccgttaccgggggaaccgtaaaacgggggcccggtaccgaaacggttaaggccgttacgcgcgngcgcgngcgngtcgngng

SEQ ID NO: 399544 - DNA, 517 bp, Homo sapiens
  misc_feature: GZ8MTXP01CWFTI.19.86.H09.1.454.CMB.2.raw
  modified_base (163)..(163): a, c, t, g, unknown or other
  modified_base (302)..(302): a, c, t, g, unknown or other
  modified_base (319)..(319): a, c, t, g, unknown or other
  modified_base (355)..(355): a, c, t, g, unknown or other
  modified_base (434)..(434): a, c, t, g, unknown or other
  modified_base (501)..(501): a, c, t, g, unknown or other
  modified_base (505)..(517): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaatcgtcatctataatgacgctgagcggtccttaagggtcccctgaccgattctctggcgagaggtctggcgctcagcttccctggccatcagngggctccagtctagagntgaggctgattattactgtgcaatcgtgggatgacngtgtgaacgggtcggtttcgggcggagggaccaagctacgaccgtctaagtcagtcccgaagcctcgcccctcggtacnccgttctcgttcccgcccctccgtcccacgagtacgtacgtgacggtcggcgtggaacaaggccganagannnnnnnnnnnnn

SEQ ID NO: 399545 - DNA, 497 bp, Homo sapiens
  misc_feature: GZ8MTXP01BEWH8.19.86.H09.1.454.CMB.2.raw
  modified_base (353)..(353): a, c, t, g, unknown or other
  modified_base (456)..(456): a, c, t, g, unknown or other
  modified_base (488)..(497): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgagctgattatactgtgcaatctgggatgacngtgtgaacgggtccggttttcggcgggagggaccaagctgaccgtctaagtcagcccaaggcctgccccctggtcactcgtcgttcccgccctcctccacggngtactgacgcgggctgggcaaggcgcattagnnnnnnnnnn

SEQ ID NO: 399546 - DNA, 501 bp, Homo sapiens
  misc_feature: GZ8MTXP01B49C9.19.86.H09.1.454.CMB.2.raw
  modified_base (316)..(316): a, c, t, g, unknown or other
  modified_base (353)..(353): a, c, t, g, unknown or other
  modified_base (498)..(501): a, c, t, g, unknown or other
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagntgaggctgattattactgtcgcaatcgtgggatgacngtgtggtaacgggttccgggttttcgggcgggagggaccaagctgaccgtctaagtcacgcccaaggctcgcccctcggtcactcgtcgttccccaccctcctccacgcgacgtactggacgcgggctgggcaaggcgcagtagnnnn

SEQ ID NO: 399547 - DNA, 551 bp, Homo sapiens
  misc_feature: GZ8MTXP01AQ1JQ.19.86.H09.1.454.CMB.2.raw
  modified_base (122)..(122): a, c, t, g, unknown or other
  modified_base (195)..(195): a, c, t, g, unknown or other
  modified_base (282)..(282): a, c, t, g, unknown or other
  modified_base (533)..(533): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggngcctggggcctcagtgaaggtctcctgcgaggcttttggatacaccttcagtcattatcatatactctgggtncgacaggcccctggacaagggcttgagtggatagggcgatccaggtggtagtgggtggcgcatacgtcgcacagaagttcagggccncgtcaccatggccaaggtcgcgtccacgaatacagtgtatatggacttgagcagcctgaggtctgacgacacggccaatgtattattgtgcgaggcagggacgggctaaaggcaataaagtggttcgacccgtggggccacgggaacctggtccacgggtctcctcacgcctccacaacgggccacgtccggtccttcccccgtgggcccgcccttggccttccgaggacgccaccttcccgaagcgcacncgccggcccgttgggccg

SEQ ID NO: 399548 - DNA, 555 bp, Homo sapiens
  misc_feature: GZ8MTXP01EQ6Y5.19.86.H09.1.454.CMB.2.raw
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccntgtattattgtgcgaggcgaggacgggactaaaggcagtaaagtggttaccgacccgtggggccagggaacctggtcaccgggtctcctcacgcctccaccgaacggcccagtccgtccttcccccgtggcccgcccttgccttccgaggacgccgcccgttccgaagacgccacgacggccggcccgttgggccg

SEQ ID NO: 399549 - DNA, 555 bp, Homo sapiens
  misc_feature: GZ8MTXP01DAYQH.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgatacagtgtatatggacttgagcagcctgaggtctgacgacaacggccntgtattattgtgcgaggcaggacggggctaaaggcataaagtggttcgacccgtggggccagggaaccctgggtccacgggtctcctcacgcctccacgaacgggcccacgtccggtccttccccgtggccgcccgttcgccttccgacggcgcgcccgttccgaacgaggccacgacgcggtcccgttggggtccg

SEQ ID NO: 399550 - DNA, 559 bp, Homo sapiens
  misc_feature: GZ8MTXP01EPLZT.19.86.H09.1.454.CMB.2.raw
  modified_base (516)..(516): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggcaatgtattattgtgcgaggcagggacggggactaaaggcaataaagtggttcgacccgtggggcacgggaaccctggtcaccgggtctcctcacgcctccaccgaacggccccatccggtccttcccccgtggcccgcccttgccttccgacggacnccgccttccgaagcgccacgacggttccggcccgttgggcccg

SEQ ID NO: 399551 - DNA, 592 bp, Homo sapiens
  misc_feature: GZ8MTXP01CPX1Q.19.86.H09.1.454.CMB.2.raw
  modified_base (508)..(508): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatcggccaaggtcgcgtccacgaatacagtgtatatggacttgagcagcctgaggtctgacgacaacggcaatgtattatgtgcgaggcagggacgggactaaaggcaagtaaaggtcggttaccgaccccgtggggccgacgggaaccctggtaccaccggtcctcctccacgccctaccgaccgtaacgggccctacgtccggttcccttcccccgnggccccgccccttcggcccttccgaacgggcgcccgacccgttccggaagacgccgacgacggcccggccccgttggggtcccg

SEQ ID NO: 399552 - DNA, 497 bp, Homo sapiens
  misc_feature: GZ8MTXP01DTWAQ.19.86.H09.1.454.CMB.2.raw
  modified_base (351)..(351): a, c, t, g, unknown or other
  modified_base (493)..(497): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgagatgaggctgattatactgtgcaatcgtgggatgacnggtgtgggaaacgggttccggttttcgggcgggaggggtaccaagctgaccgtctaagtcacgccaaggctcgcccctcggtcactcgtcgttccccaccctcctccacgagagtacctgacgcggctggcaaggcgcagannnnn

SEQ ID NO: 399553 - DNA, 569 bp, Homo sapiens
  misc_feature: GZ8MTXP01DIO9J.19.86.H09.1.454.CMB.2.raw
  modified_base (196)..(196): a, c, t, g, unknown or other
  modified_base (346)..(346): a, c, t, g, unknown or other
  modified_base (527)..(527): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtntgacacaacggcaatgtattatgtgcgagcgagggacgggactaaaggcaagtaaagtcggttaccgacccgtggggaccacgggaaccctggtccaccgggtctcctcacgccctacccaccgaacgggcccacgtccggtcccttcccccgtcggcccgcccttcgccttccgacggcnccgaccttccggaagcgccacgacggccgcccgttgggcccg

SEQ ID NO: 399554 - DNA, 585 bp, Homo sapiens
  misc_feature: GZ8MTXP01EMSPG.19.86.H09.1.454.CMB.2.raw
  modified_base (285)..(285): a, c, t, g, unknown or other
  modified_base (345)..(345): a, c, t, g, unknown or other
tcagtactctcgtgcacgaccggtgctcgatttagtgctatagactttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccaggtggtagtggtggcgcatacgtcgcacagaagttcgagggccncgtcaccatggccaaggtcgcgtcagaatacagtgtatatggacttgagcagcctgagtngacgacaacgcaatgtatatgtgcgaggcagggacgggactaaaggcaagtaaaggtcggttaccgaccccgtggggaccacgggaaccctggtccaccggtctcctcacgccctcccaccgaacgggccctacgttcccgggtcccttcccccgtcgggcccgtccccgttcgcccgttcccgacgggacgcccacccgccggaagacgccgacgacggcccggccccgttgggtcccg

SEQ ID NO: 399555 - DNA, 578 bp, Homo sapiens
  misc_feature: GZ8MTXP01DXR3I.19.86.H09.1.454.CMB.2.raw
  modified_base (196)..(196): a, c, t, g, unknown or other
  modified_base (358)..(358): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacgcntgtattatgtgcgaggcagggacggggactaaaggcaagtaaagttcgggttaccggaccccgtggggaccgaacggggaacccgtggtccaccgggtcctcctcacgcctacccaccgaacggcccacgtcccggtccttcccccgtgggcccgcccgttcgcccttccgacggacgccgcccgttccgaagacgcacgacgccggtcccgcgggtccg

SEQ ID NO: 399556 - DNA, 575 bp, Homo sapiens
  misc_feature: GZ8MTXP01AO4ZZ.19.86.H09.1.454.CMB.2.raw
  modified_base (364)..(364): a, c, t, g, unknown or other
  modified_base (375)..(375): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctagacgacgaacggcctntgtattattgngtcggaggcgagggcgggataaaggcaagtaaaggtcggtcgacccggtgggccgacgggaacccgtggtccaccgggtctccgtcgacgccctaccgaccgacggaccctacgtccggtcccttccccgcggcccgtcccttgcccttccgacggcgcccgccgttccgaagacgcacgacgcccggccgttgggcccg

SEQ ID NO: 399557 - DNA, 561 bp, Homo sapiens
  misc_feature: GZ8MTXP01DCTVP.19.86.H09.1.454.CMB.2.raw
  modified_base (445)..(445): a, c, t, g, unknown or other
  modified_base (449)..(449): a, c, t, g, unknown or other
  modified_base (542)..(542): a, c, t, g, unknown or other
tcagtactctcgtgcacgaccggtgctcgatttagtgctatagacttgggtctggggctgaggtgaaggagcctggggcctcagtgaaggtcctcctgcgaggtcttttggatacaccttcagtcattatcatatactctgggtgcgacacggcccctggacgaagggcttgagtggagtagggcggatccgaggtggtagtggtggcgcatacgtcgcacagtaagtttcgagggccgcgtcaccagtcggaccaaggtcgcgtaccaacgaatacagtgtatagtggacttgagcagcctgaggtctagacgacacggcatgtattatgtgcgaggcgaggacgggactaaaggcaagtaagtggtaccgacccgtgggaccagggaccctggaccacgtctcctcacgtccaccacgaacggcccacgtccgtcctccccgngccnccctgcctcgagacgccaccgtcgagcgccaacgcgccggccctgggctcgccgttggtacaacggtacctacttccccgagagaactacggngcggcggcgtcggcgaacg

SEQ ID NO: 399558 - DNA, 572 bp, Homo sapiens
  misc_feature: GZ8MTXP01B8K01.19.86.H09.1.454.CMB.2.raw
tcagtactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggtcttttggatacaccttcagtcattatcatatactcgtgggtgcgacacggcccctggacaagggcttgagtggagtagggcggatccgacggtggtagtggtggcgcagtacgtcgcacagtaagtttcgacgggccgcgtcaccatcgggaccaagggtccgccgtaccacgaatacagtgtatatggactgagcagcctgagtctgacgacacggcatgtattagttgtgcggaggcgagggacggggactaaagggctaaagtaaaggttgggttaccgacccggtgggggcccacggggttaacccttgggtcccaccggttcctccctcgacgtcccgttccgaacccgg

SEQ ID NO: 399559 - DNA, 501 bp, Homo sapiens
  misc_feature: GZ8MTXP01DPZIE.19.86.H09.1.454.CMB.2.raw
  modified_base (272)..(272): a, c, t, g, unknown or other
  modified_base (343)..(343): a, c, t, g, unknown or other
  modified_base (388)..(388): a, c, t, g, unknown or other
  modified_base (390)..(390): a, c, t, g, unknown or other
  modified_base (394)..(394): a, c, t, g, unknown or other
  modified_base (414)..(414): a, c, t, g, unknown or other
  modified_base (418)..(418): a, c, t, g, unknown or other
  modified_base (421)..(422): a, c, t, g, unknown or other
  modified_base (424)..(424): a, c, t, g, unknown or other
  modified_base (427)..(427): a, c, t, g, unknown or other
  modified_base (431)..(431): a, c, t, g, unknown or other
  modified_base (436)..(436): a, c, t, g, unknown or other
  modified_base (439)..(439): a, c, t, g, unknown or other
  modified_base (445)..(445): a, c, t, g, unknown or other
  modified_base (482)..(482): a, c, t, g, unknown or other
  modified_base (494)..(494): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtanatggacttgagcagcctgaggtctgacgacacggcatgtattatgtgcgagcgagggacgggcctaaaggnaagtaagtcggtacgacccgtgggccagggacctggcacgtctcncngccncacacggccagcgtctcccngccnccnncncgnggcncaccncgncgcacngccgcctggctgccttgcaacgctacttcccgagagngactgagcggcngcgaagg

SEQ ID NO: 399560 - DNA, 600 bp, Homo sapiens
  misc_feature: GZ8MTXP01ELVGZ.19.86.H09.1.454.CMB.2.raw
  modified_base (282)..(282): a, c, t, g, unknown or other
  modified_base (303)..(303): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatcgaggtggtagtggtgcgcatacgtcgcacagaagttcagggccncgtcaccatcggccaaggtcncgtccacgaatacagtgtatatggacttgacgcagcctgaggtctgacgacaacggctaagtcgtattatgtgcggagcgagggacgggactaaaggcaagtaaagtggttaccgacccgtggggaccacgggaacctggtaccaccgggtctcctccacggtccctccgaacccgaacggggcccctaacgtcccggtccctttcccccgtgggccccgtcccgttcgccgttaccgacgggaacgccgacccgttccgaagaccgcaacgcggccggtccccgttcgggtcccgg

SEQ ID NO: 399561 - DNA, 502 bp, Homo sapiens
  misc_feature: GZ8MTXP01EZ1T2.19.86.H09.1.454.CMB.2.raw
  modified_base (353)..(353): a, c, t, g, unknown or other
  modified_base (454)..(454): a, c, t, g, unknown or other
  modified_base (491)..(491): a, c, t, g, unknown or other
  modified_base (493)..(502): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgtattctctggcgagaggtctggcgcctcagcttccctggccatcagagggctccagtctgaagatgaggctgattattactgtgcaatcgtggatgacngtgtgaacgggtcggttttcggcggagggacaagctgaccgtctaagtcacgcccaaggctcgcccctcggtcactcgtcgttccccgccctcctccacgngacgtacgtgacggcggctgggcaagggcgcttaagngnnnnnnnnnn

SEQ ID NO: 399562 - DNA, 527 bp, Homo sapiens
  misc_feature: GZ8MTXP01A6OTP.19.86.H09.1.454.CMB.2.raw
  modified_base (163)..(163): a, c, t, g, unknown or other
  modified_base (516)..(527): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcaagaaagtcccaggaaccgccccaaatcgtcatctataatgacgctgagcggtccttaagggtccctgaccgtattcctctggcgagaggtctggcgcctcagcttccctggccatcagagggctcagtctgaagatgagctgtattattactgtcgctaatcgtgggatgactggtggtacggtaacgggttcccgggttttacgggcgggagggtaccaagcgtcgaccgtcctaaagtcgacgcccaaggcctcgcccctcgtcacctcgtcgtccccgccctccctccacgacgacgtacgtgacggcggcgtggcgaaggcgcagagnnnnnnnnnnnn

SEQ ID NO: 399563 - DNA, 541 bp, Homo sapiens
  misc_feature: GZ8MTXP01EJWK2.19.86.H09.1.454.CMB.2.raw
  modified_base (359)..(359): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggcntgtattatgtgcgaggcaggacgggactaaaggcaagtaaagtggttcgacccgtggggccacgggaacctggtcaccgggtctcctcacgcctccaccgacggcccactcgtcctcccctggccgcccttgccttccgaggcgccgccttccgaagagcacgacgccggcccgttgggccg

SEQ ID NO: 399564 - DNA, 547 bp, Homo sapiens
  misc_feature: GZ8MTXP01DI3N0.19.86.H09.1.454.CMB.2.raw
  modified_base (302)..(302): a, c, t, g, unknown or other
  modified_base (357)..(357): a, c, t, g, unknown or other
  modified_base (368)..(368): a, c, t, g, unknown or other
  modified_base (528)..(528): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcagggccgcgtcaccatggccaaggtcncgtccacgaatacagtgtatatggacttgagcagcctgaggtctgacacacggcntgtattatgtncgaggcaggacgggactaaaggcaataaagtggttcgacccgtggggccagggaaccctggtccaccggtctcctcacgcctccaccaacgggcccagtccggtccttcccccgtggcccgcccttcgccttccgaggcgcgcccttccgaagacgcacncggccggcccgttgggccg

SEQ ID NO: 399565 - DNA, 545 bp, Homo sapiens
  misc_feature: GZ8MTXP01BLOOL.19.86.H09.1.454.CMB.2.raw
  modified_base (360)..(360): a, c, t, g, unknown or other
  modified_base (387)..(387): a, c, t, g, unknown or other
  modified_base (521)..(521): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacgggccntgtattatgtgcgaggcaggacggggntaaagggcaagtaaagtcggttacgaccccgtggggccagggaacccctgggtccaccggtctcctcacgcctccaccagggcccatcggtcttcccctggccgcccttgcttccgaggcgcgccttccgaagngccacacggccgcccgttgggccg

SEQ ID NO: 399566 - DNA, 593 bp, Homo sapiens
  misc_feature: GZ8MTXP01BRVOQ.19.86.H09.1.454.CMB.2.raw
  modified_base (548)..(548): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatcggccaaggtccgcgtccacgaatacagtgtatagtggacttgagcagcctggaggtctagacgacaacgggcctgtgtatttagttgtggacgagggcgagggacggggactaaagggcaagttaaaggtcggttccgaccccgtggggaccgacgggaccctggtccaccgggtctcctcgacgccctccgaccgacggccccagtcccggttccttcccccgtggcccgtcccgttcgcccttccgacgggcnccgccgttccgaagcgccaacgcggcccggtcccgttcgggcccg

SEQ ID NO: 399567 - DNA, 579 bp, Homo sapiens
  misc_feature: GZ8MTXP01DZR3G.19.86.H09.1.454.CMB.2.raw
  modified_base (117)..(117): a, c, t, g, unknown or other
  modified_base (163)..(163): a, c, t, g, unknown or other
  modified_base (259)..(259): a, c, t, g, unknown or other
  modified_base (338)..(338): a, c, t, g, unknown or other
  modified_base (567)..(567): a, c, t, g, unknown or other
  modified_base (569)..(579): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggnagacggtcaccatcgcttgttctgcaagcagctcgaacatcgggancagtggtgtgatgtggtatcagaaagtcccaggaaccggccccaaatcgtcatctataatgacgctgagcggtccttaagggccctgaccgattcnctggcgagaggtctggcgcctcacgcttcccgtggccatcagagggctccagtctgaagatgaggctgattatctgtcncaatcgtgggatgactggtgttgggaaaccgggttccggttttacgggcggggtaacgggaccaaagtcgtacgaccgtactaaacgtcgaacggcgacgaacgggccttccgcccccgttacgggtccctaacgttcccgttcgtttcccccgccccttcccgtcccgaaccgtaggaacgtaaccgtggacggtccgggcgtcgggcaaaggggcgcgtaaagtagngnnnnnnnnnnn

SEQ ID NO: 399568 - DNA, 553 bp, Homo sapiens
  misc_feature: GZ8MTXP01BE4W4.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttaagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgacggtctgacgacacggccatgtattattgtgcgaggcagggacggggctaaaggcataaagtggttcgacccgtggggccagggaccctggtcaccgtcgtctcacgcctccaccgaacggcccactccggtccttccccctcggccgccctcgcctccacggacgccacccgttccgacgaacgcaacgacgccggcccgtcgggcgtcgg

SEQ ID NO: 399569 - DNA, 560 bp, Homo sapiens
  misc_feature: GZ8MTXP01A86W4.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatcggccaaggtcgcgtccacgaatacagtgtatatggacttgagcagcctgaggtctgacgacaacggcaatgtattatgtgcgaggcgagggacgggactaaagggcaagtaaagtcgggttacgaccccgtggggaccgagggaaccctggtccaccgggtctcctcacgcctaccgaccgaacggcccagtccgtccttccccgtggcccgcccttcgccttccgaggcgccgccttccgaagcgcacgagccggcccgttgggccg

SEQ ID NO: 399570 - DNA, 529 bp, Homo sapiens
  misc_feature: GZ8MTXP01EAK6I.19.86.H09.1.454.CMB.2.raw
  modified_base (254)..(254): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcncatacgtcgcacagaagttcagggccgcgtcaccatggccaaggtcgcgtccagaatacagtgtatatggacttgagcagcctgaggtctgacgacaacggccaatgtattatttgcgaggcgagacggggctaaaggcataaagtggttacgaccccgtggggccgagggaaccctggtacaccgtctcctcacgcctccacacggccactcgtcctccctgccgcctgctccacgagcaccgttccgagcgcaacagcggcctcgggcgtccg

SEQ ID NO: 399571 - DNA, 575 bp, Homo sapiens
  misc_feature: GZ8MTXP01ANCK3.19.86.H09.1.454.CMB.2.raw
  modified_base (525)..(525): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtgtagtggtggcgcatacgtcgcacagaagttcagggccgcatcaccatggccaaggtcgcgtccacgaatacagtgtatatggacttgagcagcccctggagtctgacgaacacggcatgtattatgtgcgaggcgagggacggggactaaaggctaagtaaaggtcggtaccgaccccgtgggggcccgaacgggaacccgtgggtaccgacccggtcctcctcgacgccctccgaccgaacgggccccacgtccggtcccttcccccgtggccgcccgtcnccgtcccaggacgcacccgtccgacgcgcacgacgccggttcccgtcggg

SEQ ID NO: 399572 - DNA, 561 bp, Homo sapiens
  misc_feature: GZ8MTXP01A2XSP.19.86.H09.1.454.CMB.2.raw
  modified_base (360)..(360): a, c, t, g, unknown or other
  modified_base (373)..(373): a, c, t, g, unknown or other
  modified_base (494)..(494): a, c, t, g, unknown or other
  modified_base (500)..(500): a, c, t, g, unknown or other
  modified_base (523)..(523): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacgaacggcntgtattagtgtgngaggcgagggacgggacgtaaaggcaagtaaggtcggtaccgacccgtggggaccacgggaccctggtccaccggtctccgtcacgccctccaccgacggccctagtccgtccctccccgnggcccnccgttgccttccgacggcgcccnccgttccgaacgcgccacgcgcccggtccgcgggtccg

SEQ ID NO: 399573 - DNA, 571 bp, Homo sapiens
  misc_feature: GZ8MTXP01BNBVD.19.86.H09.1.454.CMB.2.raw
  modified_base (362)..(362): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatcggccaaggtcgcgtccacgaatacagtgtatatggacttgagcagcctgaggtctgacgacgaacggcntgtattattgtgcgagcgagggacgggacgtaaaggcaagtaagtcggttaccgacccgtcggggccgacgggaaccgtcggtccaccgggtctcctccacgccctcccgacgaacggcccacgtccgtccctccccgtggccgcccgttcgccttccgacggcgccgccttccggaagacgcgacgcggccggtcccgttgggtcccg

SEQ ID NO: 399574 - DNA, 579 bp, Homo sapiens
  misc_feature: GZ8MTXP01C1G9P.19.86.H09.1.454.CMB.2.raw
  modified_base (502)..(502): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtgcgacaggcccctggacaagggcttgagtggagtagggcgatccgaggtggtagtggtggcgcatacgtcgcacagaagttcagggccgcgtcaccatcggccaaggtcgcgtccaacgaatacagtgtatagtggacttgagcagcctgaggtctgacgacaacggcaatgtattattgtgcgaggcgagggacggggactaaaggcaagtaaacggtggttaccgacccgtggggaccgacgggaaccctggtccaccggtctcctcacgcctccaccgacggcccagtccggtccttccccgnggcccgcccttcgccttccgacgggcgttccgcccttccggaagacgccaacggcgccggtcccgttcggggtcccg

SEQ ID NO: 399575 - DNA, 570 bp, Homo sapiens
  misc_feature: GZ8MTXP01AQ9Q9.19.86.H09.1.454.CMB.2.raw
  modified_base (361)..(361): a, c, t, g, unknown or other
  modified_base (527)..(527): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacaacggccntgtattattgtgcgaggcgagggacggggactaaaggcaagtaaaggtcggttaccgaccccgtggggccgacgggaacccgtggtcaccggtctcctcacgcctccgaccgacgggcccacgtccggtccttcccccgtggcccgcccttggccttccgaggacnccgacccgttccgaagcgccaacgcgccggcccgttcgggccg

SEQ ID NO: 399576 - DNA, 619 bp, Homo sapiens
  misc_feature: GZ8MTXP01CKEXV.19.86.H09.1.454.CMB.2.raw
  modified_base (382)..(382): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgatccgaggtggtagtggtggcgcatacgtcgcacgagaagttcagggccgcgtcaccatcggccaaggtcgcgtaccaacgaatacagtgtatatggacttgagcagcctgaggtctgacgacgaacggcctaatgtaattagttgngcggaggcgagggacgggactaaaggcaagtaaaggtggttacccgacccgtcggggaccgaacgggaaccctgggtacctaccgggtccttcccgtccgacgtccctacccgaacccgaacgggcccctacgttcccggttcccttcccccgtggcccgtccccttcggcccttccgacggcgttcccgcccgttcccggaaggacgcaccgacggccggtcccgttggggtcccg

SEQ ID NO: 399577 - DNA, 526 bp, Homo sapiens
  misc_feature: GZ8MTXP01CEKA5.19.86.H09.1.454.CMB.2.raw
  modified_base (515)..(516): a, c, t, g, unknown or other
  modified_base (518)..(526): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgtattctctggcgagaggtctggcgcctcagcttccctggccatcagagggctccagtctgagatgaggctgattattactgtcgcaatcgtggatgactaagtgtaggaacgggttccggtttcgggcgggagggaccaagctaggaccgtctaagtcacgccccaaggcctcgcccccgtacgtccacctccgttcgttccccaccctccctaccacgacgacgtactgacggtcgggctgggcaacggcgacacgtagnngnnnnnnnnn

SEQ ID NO: 399578 - DNA, 373 bp, Homo sapiens
  misc_feature: GZ8MTXP01BQO1V.19.86.H09.1.454.CMB.2.raw
  modified_base (368)..(373): a, c, t, g, unknown or other
tcagtactctcgtgcacgaccggtgctcgatttagtgctatagacttgggtttgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagaggctccagtctgaagatgaggctgattattactgtgcaatctgggatgacagtgtgacggtcggtttgcgaggcagctgaccgtctagtcagcccaaggctgccccctggtccactctcgttcccaccctcctccacgagacgtactgagcgggctgggcaaggcgcatagnnnnnn

SEQ ID NO: 399579 - DNA, 534 bp, Homo sapiens
  misc_feature: GZ8MTXP01BG0TJ.19.86.H09.1.454.CMB.2.raw
  modified_base (163)..(163): a, c, t, g, unknown or other
  modified_base (317)..(317): a, c, t, g, unknown or other
  modified_base (336)..(336): a, c, t, g, unknown or other
  modified_base (352)..(352): a, c, t, g, unknown or other
  modified_base (491)..(491): a, c, t, g, unknown or other
  modified_base (521)..(534): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggccccaaatcgtcatctataatgacgctgagcggtccttaagggtccctgaccgattctctggcgagaggtctggcgcctcagcttccctggccatcagagggctcagtctgagangagctgattattactgtcncaatcgtgggatgacnggtgtaggtaacggttccgggttttcgggacgggagggtaccaagcgtacgtaccgtctaagtcaacggtacccaacggtctccgcccctcggtctaccgtctccgttccccggcccctcctccgacgagacgttacgngacggcggcgtggcgaacggcgacgttagnnnnnnnnnnnnnn

SEQ ID NO: 399580 - DNA, 565 bp, Homo sapiens
  misc_feature: GZ8MTXP01DF1AZ.19.86.H09.1.454.CMB.2.raw
  modified_base (361)..(361): a, c, t, g, unknown or other
  modified_base (527)..(527): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtgcgacaggcccctggacaagggcttgagtggatagggcgatccgaggtggtagtggtggcgcatacgtcgcacagaagttcagggccgcgtcaccatcggccaaggtcgcgtccacgaatacagtgtatatggacttgagcagcctgaggtctgacgacacggcngtgtattattgtgcgagggcagggacgggactaaaggcaagttaaagtcggttacgaccccgtggggccgaacgggacctcggtccacggggtctcctcacgcctccaccgacggcccacgtccggtccctccccgtcggccgtcccttcgccttcgacggcgccnccgttccggaagacgcacgcggccgtccgttgggtccg

SEQ ID NO: 399581 - DNA, 555 bp, Homo sapiens
  misc_feature: GZ8MTXP01DM7ZS.19.86.H09.1.454.CMB.2.raw
  modified_base (500)..(500): a, c, t, g, unknown or other
  modified_base (521)..(521): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacagaagttcagggccgcgtcaccatggccaaggtcgcgtccacgaatacagtgtatatggacttgagcagcctgaggtctgacgacaacggccaatgtattattgtgcgagggcagggacggggactaaaggcaagtaaagtggttaccgaccccgtggggccacgggaaccctggtccacgggtctcctcacgcctccaccgaacgggcccagtccggtcctccccgtggccncccttgccttccgaggcgccnccttccgaagacgcacgacgccggccgttggccg

SEQ ID NO: 399582 - DNA, 548 bp, Homo sapiens
  misc_feature: GZ8MTXP01EDY82.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccagaatacagtgtatatggacttgagcagcctgaggtctgacgacaacggcaatgtattatgtgcgagcaggacgggctaaaggcataaagtggtcgacccgtggggccagggaacctgtcaccggtctcctcacgcctccaccaacgggcccagtccggtccttcccccgtggccgccccttggccttccgacggcgccgacccttccggaagacgcacgacggccggccccgttgggtccg

SEQ ID NO: 399583 - DNA, 566 bp, Homo sapiens
  misc_feature: GZ8MTXP01CT945.19.86.H09.1.454.CMB.2.raw
  modified_base (195)..(195): a, c, t, g, unknown or other
  modified_base (530)..(530): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccaatgtattattgtgcgaggcgagggacgggacgtaaaggcaagtaaaaggtgggttaccgaccccgtgggggacccgacgggaacccctggtccaccgggtctccctcacgccctccaccacgggcccagtccgtccttccccgtggccgcccttcgcttccgacggcgccnccttccgaagacgcacgcgccggtcccgttgggccg

SEQ ID NO: 399584 - DNA, 513 bp, Homo sapiens
  misc_feature: GZ8MTXP01BR6HP.19.86.H09.1.454.CMB.2.raw
  modified_base (343)..(343): a, c, t, g, unknown or other
  modified_base (352)..(352): a, c, t, g, unknown or other
  modified_base (477)..(477): a, c, t, g, unknown or other
  modified_base (494)..(494): a, c, t, g, unknown or other
  modified_base (499)..(509): a, c, t, g, unknown or other
  modified_base (511)..(511): a, c, t, g, unknown or other
  modified_base (513)..(513): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctagaccgattctcgtggcgagaggtctggcgctcagcttccctggccatcagagggctccagtctgagatgaggctgattatactgtcgcaatcngggatgacngtgtgtacggtcggtttggcgggagggacccagctcgaccgtctaagtcacgcccaaggcctcgccccctcggtcaccgtcgtcgtttccccgcccctcctccaccgagcgtactggagccgggngtacggcgaaggccganagtgnnnnnnnnnnngngn

SEQ ID NO: 399585 - DNA, 584 bp, Homo sapiens
  misc_feature: GZ8MTXP01DAVN4.19.86.H09.1.454.CMB.2.raw
  modified_base (360)..(360): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggccntgtattattgtgcgagggcgagggacggggactaaaggcaagtaaagtggttcggaccccgtggggccacggggaaccctggtccaccggggtctccgtcacgcctaccgaccgtaacgggccctagtccggttccttcccccgtggcccgtcccttcgccttccgacgggacgccgacccttccggaacgacgccacgacggcccggcccgttgggggtcccg

SEQ ID NO: 399586 - DNA, 575 bp, Homo sapiens
  misc_feature: GZ8MTXP01A85RH.19.86.H09.1.454.CMB.2.raw
  modified_base (264)..(264): a, c, t, g, unknown or other
  modified_base (282)..(282): a, c, t, g, unknown or other
  modified_base (290)..(290): a, c, t, g, unknown or other
  modified_base (303)..(303): a, c, t, g, unknown or other
  modified_base (347)..(347): a, c, t, g, unknown or other
  modified_base (462)..(462): a, c, t, g, unknown or other
  modified_base (505)..(505): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcncacagaagttcagggccncgtcaccntcggccaaggtcncgtccagaatacgagtgtatatggacttgagcagcctgaggtcngacgacaacggcaatgtaattagtgtgcggaggcagggacgggactaaagggcaagtaaaggtcggttaccgacccgtggggaccacgggaaccctggtccacggggtctccctnacgtcctacccgaccgaagggccccagtccgtcccttccccgnggcccgtcccttgccttcccgagaccgccacccgttctaaggcgccacgcggccgtcccgttgggaaccc

SEQ ID NO: 399587 - DNA, 548 bp, Homo sapiens
  misc_feature: GZ8MTXP01EU74S.19.86.H09.1.454.CMB.2.raw
  modified_base (163)..(163): a, c, t, g, unknown or other
  modified_base (364)..(364): a, c, t, g, unknown or other
  modified_base (538)..(548): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaacgtcccaggaaccggcccccaaatcgtcatctataatgacgctgagcggtccttaagggtccctgaccgtattctcgtggcgagaggtctggcgcctcagcttccctggccatcgagagggctccgagtctgaagatgaggctgtattattactgttcgctaatcgtgggatgacnggttgtaggtacgggttccggttttcgggcgggacgggacaagctcggaccgtcgtaagtcacgtcccgaacggcctaccgcccccgtcgtacaccgttccgttccgttccccggtcccctttccgtacccgacgacgtacgtacgtggacggcgggcctggctaaggcgcagnnnnnnnnnnn

SEQ ID NO: 399588 - DNA, 635 bp, Homo sapiens
  misc_feature: GZ8MTXP01B6YE6.19.86.H09.1.454.CMB.2.raw
  modified_base (387)..(387): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggagtagggcgatccgaggtggtagtggtggcgcatacgtcgcacagaagttcgagggcccgcgtcaccagtcggccaaggtccgcgtccaacgaatacagtgtatatggacttgagcagcctggacggtctgaccgacgaacggccaagttgtattagttgngcggaggcgagggacgggactaaaggcaagtaaagtcgggttaccgacccgtcgggggaccgaacggggaacccgtcgggtaccacccgggttccgttaccgtccgtacgacccctcccgaaacccgaacgggtaccccgtacgtcccggttcccttcccccgtcgggccccgtccccgttcgtcccgccgacggcgcccgcccgttaccggaacgacgccacgacggccgggtcccgttcgggcccg

SEQ ID NO: 399589 - DNA, 555 bp, Homo sapiens
  misc_feature: GZ8MTXP01CW0AZ.19.86.H09.1.454.CMB.2.raw
  modified_base (282)..(282): a, c, t, g, unknown or other
  modified_base (358)..(358): a, c, t, g, unknown or other
  modified_base (369)..(369): a, c, t, g, unknown or other
  modified_base (491)..(491): a, c, t, g, unknown or other
  modified_base (496)..(496): a, c, t, g, unknown or other
  modified_base (514)..(514): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacagaagttcagggccncgtcaccatcggccaaggtcgcgtccacgaatacagtgtatatggacttgagcagcctgaggtctgacacacggcntgtattattgngcgaggcagggacgggataaaggcaagtaaaggtggttccgacccgtggggaccacgggaaccctggtccaccgggtctccgtcacgcctccgaccgacgggcccagtccgtccttccccgnggccncccgttgccttcgaggcnccgccgttccgaagacgcgacgcggccggtcccgttggccg

SEQ ID NO: 399590 - DNA, 554 bp, Homo sapiens
  misc_feature: GZ8MTXP01BK5UY.19.86.H09.1.454.CMB.2.raw
  modified_base (345)..(345): a, c, t, g, unknown or other
  modified_base (358)..(358): a, c, t, g, unknown or other
  modified_base (369)..(369): a, c, t, g, unknown or other
  modified_base (511)..(511): a, c, t, g, unknown or other
  modified_base (521)..(521): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgccgtccacgaatacagtgtatatggacttgagcagcctgaggtntgacgacacggcntgtattattgngcgaggcagggacggggactaaagggcaagtaaaggtggtccgacccgtggggccaggggaaccctggtccaccggtctcctcacgccctccgaccgaacggcccagtccggtcctccccgtggcccgcccttgccttccgnggcgccgccncgaagacgccacgacggccggcccgttgggccg

SEQ ID NO: 399591 - DNA, 575 bp, Homo sapiens
  misc_feature: GZ8MTXP01AEHGS.19.86.H09.1.454.CMB.2.raw
  modified_base (357)..(357): a, c, t, g, unknown or other
  modified_base (531)..(531): a, c, t, g, unknown or other
  modified_base (554)..(554): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagttcagggccgcgtcaccatggccaaggtcgcgtccacgaatacagtgtatatggacttgagcagcctgaggtctgacacaacggccntgtattatgtgcgaggcgagggacgggactaaaggctaagtaaaggtcggtaccgaccccgtggggaccgacggggaacccgtggtccaaccgggtctcccgtcgaccgcctcccgaccgaacgggcccacgtccggtccttcccccgtggcccgcccttgccttccgacggcnccgcccttcgaacgacgcgaacncggccgcccgttggggtcccg

SEQ ID NO: 399592 - DNA, 573 bp, Homo sapiens
  misc_feature: GZ8MTXP01C06YT.19.86.H09.1.454.CMB.2.raw
  modified_base (196)..(196): a, c, t, g, unknown or other
  modified_base (283)..(283): a, c, t, g, unknown or other
  modified_base (362)..(362): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagttcagggccncgtcaccatcggccaaggtcgcgtccaacgaatacagtgtatatggacttgagcagcctgaggtctgacgacaacggcntgtattatgtgcgaggcagggacgggactaaaggcaagtaaaggtggttccgacccgtggggccacgggtaaccctggtccaccggggtctcctcacgccctccaccgacggcccagtccggtccttccccgtggcccgtcccgttgccgttccgaagggtcgaccgcccgttccgaagcgccgacgacggccggtcccgttggggtcccg

SEQ ID NO: 399593 - DNA, 567 bp, Homo sapiens
  misc_feature: GZ8MTXP01APF4Z.19.86.H09.1.454.CMB.2.raw
  modified_base (285)..(285): a, c, t, g, unknown or other
  modified_base (349)..(349): a, c, t, g, unknown or other
  modified_base (375)..(375): a, c, t, g, unknown or other
  modified_base (531)..(531): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacaggcccctggacaagggcttgagtggatagggcgatccgaggtggtagtggtggcgcatacgtcgcacagaagttcagggcccncgtcaccatggccaaggtcgcgtccacgaatacagtgtatatggacttgagcagcctgaggtcngacgacaacggccaatgtattattgngcgaggcagggacgggactaaaggcaagtaaaggtcggtccgacccgtggggccgacgggaccctggtccaccgggtctccctcacgccctccgaccgacgggcccacgtccggtcccttcccccgtggcccgcccttggccttccgaggacgccnccgttccgaagcgcacgcggccggcccgttggggcc

SEQ ID NO: 399594 - DNA, 581 bp, Homo sapiens
  misc_feature: GZ8MTXP01C2RW9.19.86.H09.1.454.CMB.2.raw
  modified_base (197)..(197): a, c, t, g, unknown or other
  modified_base (284)..(284): a, c, t, g, unknown or other
  modified_base (304)..(304): a, c, t, g, unknown or other
  modified_base (514)..(514): a, c, t, g, unknown or other
  modified_base (533)..(533): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctggggtncgacaggcccctggacaagggcttgagtggatagggcgatccgaggtggtagtggtggcgcatacgtcgcacagaagttcagggccncgtcaccatcggcaaggtcncgtccacgaatacagtgtatatggacttgagcagcctgaggtctgaccgacacggcaagtgtaattattggtgacggaggcgagggacgggataaaggctaagtaaaggtcggttaccgaccccgtgggggccaacgggtaccctagggtccaccgggtcctccgtcacgccctcccgaccgaacgggcccagtcccgtccttcccccgnggcccgccccttggtcccnccgacggcgccgccgcgaacgcgccgacgacggcccggtccgcggtcg

SEQ ID NO: 399595 - DNA, 580 bp, Homo sapiens
  misc_feature: GZ8MTXP01A5HIA.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgagggtggtagtggtggcgcatacgtcgcacagaagttcagggccgcgtcaccatcggaccaaggtcgcgtccagaatacagtgtatatggacttgagcagctgaggtctgacgacaacggcaatgtattattgtgcgaggcagggacgggagtaaaggacaagtaaggtgggttaccgacccgtggggccagggacccgtgtaccgcgggtctccgtccacggccctccgaacccgaacgggccccacgttcccgggttcccttcccccgtcggcccgtcccgttgcccttccgaggcgcgcccgttccgaacgacgcaacgcgccggccgttcgggcccg

SEQ ID NO: 399596 - DNA, 503 bp, Homo sapiens
  misc_feature: GZ8MTXP01BNY2G.19.86.H09.1.454.CMB.2.raw
  modified_base (164)..(164): a, c, t, g, unknown or other
  modified_base (352)..(352): a, c, t, g, unknown or other
  modified_base (487)..(487): a, c, t, g, unknown or other
  modified_base (494)..(503): a, c, t, g, unknown or other
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggancagtggtgtgatgtggtatcagaaagtcccaggaaccgcccccaaatcgtcatctataatgacgctgagcggtccttaagggtccctgaccgattctctggcgagaggtctggcgcctcagcttccctggccatcagagggctccagtctgaagatgagctgattatactgtcgcatctgggatgacngtgtgaacggtcggtttggcggtagggaccaagctcgaccgtcctaagtcacgcccaaggctcgccccctcggtcaccgtctcgttccccaccctccctccacgagacgtactcggagtcgggctgggcaacggngcatagnnnnnnnnnn

SEQ ID NO: 399597 - DNA, 503 bp, Homo sapiens
  misc_feature: GZ8MTXP01AOCU0.19.86.H09.1.454.CMB.2.raw
  modified_base (259)..(259): a, c, t, g, unknown or other
  modified_base (350)..(350): a, c, t, g, unknown or other
  modified_base (414)..(414): a, c, t, g, unknown or other
  modified_base (492)..(503): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattcnctggcgagaggtctggcgcctcagcttccctggccatcagagggctcagtctgagatgagctgattattactgtcgcaatctgggatgacngtgtggaacgggttccggtttgggcggagggaccaagctgaccgtctaagtcacgccaaggccncgcccctggtccacgtcctcgttccccaccgtccctaccacgcgagtacgtgtacgcggctgggcaaggcgcagtagnnnnnnnnnnnn

SEQ ID NO: 399598 - DNA, 583 bp, Homo sapiens
  misc_feature: GZ8MTXP01C2VFA.19.86.H09.1.454.CMB.2.raw
  modified_base (163)..(163): a, c, t, g, unknown or other
  modified_base (282)..(282): a, c, t, g, unknown or other
  modified_base (571)..(583): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcggtccttaagggtcccctagaccgtattctcgtggcgagaggtctggccncctcagtccttcccgtggcccatcgaggacggcctccgagtctagaagatggaggcttagtatttaattactgtacgactaagtcgtagggattaagacgtggttggtacggtaaccggggtttccgggtttcgggacgggtagggacccaagtctacggaccgtctaagtcgacgcccgaaggccctcggccccctcggtccaccgttcgtacccgttccccgaccctcccgtaccgacggagtacgttacgtggacggtcggcgtcggaaccgaaggcgacagtagnnnnnnnnnnnnn

SEQ ID NO: 399599 - DNA, 563 bp, Homo sapiens
  misc_feature: GZ8MTXP01ADE52.19.86.H09.1.454.CMB.2.raw
  modified_base (344)..(344): a, c, t, g, unknown or other
  modified_base (528)..(528): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcgagggccgcgtcaccatggccaaggtcgcgtccagaatacagtgtatatggacttgagcagcctgaggtntgacgacaacggccaatgtattagttgtgcgagcgacgggacggggactaaaggcaagtaaagtggtcgacccgtggggaccgacgggaacctggtccaccgggtctccgtcacgccctccgaccgaacgggcccacgtccggtccttcccccgtggcccgccttcgaccttccgacggcgccnccgccgaagacgcacgcgccggtccgttcgggccg

SEQ ID NO: 399600 - DNA, 686 bp, Homo sapiens
  misc_feature: GZ8MTXP01C0TJP.19.86.H09.1.454.CMB.2.raw
  modified_base (163)..(163): a, c, t, g, unknown or other
  modified_base (219)..(219): a, c, t, g, unknown or other
  modified_base (261)..(261): a, c, t, g, unknown or other
  modified_base (674)..(686): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctanaatgacgctgagtcggtccttaagggtccctgaccgtattcncgtggcgagaggtctggcgcctcagtccttcccgtggcccatcgagacggggcctccgagtctaggaaagagttggaacggtcttaggtaacttttaattacgttggtacgtacctaaagttcgtaggggtaataacggtaactaagggttcggttacgggtaaacccgggggtttccccggggttttacggggaccggggtaacggggacccgtaaaggtccgtacggtaaccccggttccgtaaacgttacccgaacggtaccccgtaaacgggtcccgttccggccccccgttcgggtaccctacccgtttccggttcccgtttacccccggtcccctcccgtacccgtaaccggaacggtacggttacccgtggtacggccgggcgtacgggcgaacggcgcaagtggnnnnnnnnnnnnn

SEQ ID NO: 399601 - DNA, 493 bp, Homo sapiens
  misc_feature: GZ8MTXP01EW437.19.86.H09.1.454.CMB.2.raw
  modified_base (260)..(260): a, c, t, g, unknown or other
  modified_base (352)..(352): a, c, t, g, unknown or other
  modified_base (484)..(493): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattcnctggcgagaggtctggcgctcagcttccctggccatcagagggctccagtctgaagatgaggctgattatactgtcgcaatctgggatgacngtgtgaacggtcggtttcggcgggagggaccaagctgaccgtctaagtcagcccaaggctgccccctcggtcactctcgttccccgcccttcctccacgagagtactgagcgggctggcaaggcgcagtagnnnnnnnnnn

SEQ ID NO: 399602 - DNA, 574 bp, Homo sapiens
  misc_feature: GZ8MTXP01CEQNW.19.86.H09.1.454.CMB.2.raw
  modified_base (359)..(359): a, c, t, g, unknown or other
  modified_base (369)..(369): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacagaagttcagggccgcgtcacatggccaaggtccgcgtccacgaatacgagtgtatatggacttgagcagcctgaggtctgacacaacggcntgtattatgngcgaggcgaggacgggataaaggcaagtaaaggtcggttccgacccgtggggaccacgggaaccctggtaccgaccggtctccgtcgacgccctcccgaaccgaccgggcccacgtcccggtcccttcccccgtggccccgtcccttcgcccttccgacggcgccgccttccgaagacgcacgacggccggtcccgttgggtccg

SEQ ID NO: 399603 - DNA, 567 bp, Homo sapiens
  misc_feature: GZ8MTXP01AB8OA.19.86.H09.1.454.CMB.2.raw
  modified_base (272)..(272): a, c, t, g, unknown or other
  modified_base (319)..(319): a, c, t, g, unknown or other
  modified_base (321)..(321): a, c, t, g, unknown or other
  modified_base (539)..(539): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtanatggacttgagcagcctgaggtctgacgcacggccatgtattattgngngaggcgaggacgggactaaggcaataaagtcggttacgaccccgtgggaccaggggaaccctgggccaccgtctcctcacgccctaccgaccgaacgggcccacgttccgggtccttcccccgtggccgccctcgcctaccggaggacgccaccctccgagaccacgcggtccgccgtgggctcgctcggcaacggctacctcccgagcggagtaacnggaagtcgggcgttacggcgaacggccg

SEQ ID NO: 399604 - DNA, 571 bp, Homo sapiens
  misc_feature: GZ8MTXP01E0WE9.19.86.H09.1.454.CMB.2.raw
  modified_base (333)..(333): a, c, t, g, unknown or other
  modified_base (395)..(395): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcaggccgcgtcaccatggccaaggtcgcgtccacgaatacagtgtatatggacttgancagcctggaggtctgacgacaacggcaagtgtaattagttgtagcgaggcgagggacggggntaaaggcaagtaaagtggtaccgaccccgtggggaccacgggaacccgtggtccaccggggtctcctcacgccctccaccgaacggccccagtccggtcctccccgtggccgcccttgccttccgacggcgccgccgttcccgaagcgccgacacggccggtcccgttcgggtccg

SEQ ID NO: 399605 - DNA, 572 bp, Homo sapiens
  misc_feature: GZ8MTXP01EYMBE.19.86.H09.1.454.CMB.2.raw
  modified_base (195)..(195): a, c, t, g, unknown or other
  modified_base (332)..(332): a, c, t, g, unknown or other
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtcgcacagaagttcagggccgcgtcaccatggccaaggtcgcgtccacgaatacagtgtatatggacttgancagcctgaggtctggcgacaacggccntgtattattgtgcgaggcgagggacgggactaaaggcaagtaaagtggttaccgacccgtggggccgacgggaaccctggtccgaccggtctccgtcacgccctcccgaccgaacgggccctagtccgtccttcccccgtggcccgtcccttgccttccgacggcgccgacccgttccgaagcgccacgaggcccggtcccgttcgggtcccg

SEQ ID NO: 399606 - DNA, 618 bp, Homo sapiens
  misc_feature: GZ8MTXP01BQKRZ.19.86.H09.1.454.CMB.2.raw
  modified_base (366)..(366): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagttcagggccgcgtcaccatggccaaggtccgcgtaccagaatacagtgtatatggacttgagcagcctgaggtctgacgacgaaccgggccntcgtattagttgtgcggaggcgagggacggggactaaagggcaagtaaaggttcgggttaccggaccccgtgggggacccacggggaaccctcggtaccgaccggggtccttccgtccacggcccctccgaccgaacggggcccctacgtcccggttcccttccccgcggcccgccccgttgcccttccgacgggtcgcccacccgttccggaacgcgaacccgacgacgggccggtcccgttggggtcccg

SEQ ID NO: 399607 - DNA, 574 bp, Homo sapiens
  misc_feature: GZ8MTXP01BZGZX.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgaggtctgacgacaacggcntgtattatgtgcgagcagggacgggctaaaggcataaaggtggttcgaccctgggggccagggaaccctggtccaccggtctcctcacgcctcccaccgaacgggcccctatccgggttcccttccccctcgggccgtccccttcggcttaccgacggggacacccgcccttccggaagacggcaaccggagccccgggggtcccttgggggcccg

SEQ ID NO: 399608 - DNA, 595 bp, Homo sapiens
  misc_feature: GZ8MTXP01CBNM9.19.86.H09.1.454.CMB.2.raw
  modified_base (569)..(569): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcacatggccaaggtcgcgtccaacgaatacagtgtatagtggacttgagcagccgtggaggttctaggaccgacgaacgggcccaagtgtaattagttgtgacggagggcgagggacggggactaaaggcaagtaaaggtcggttaccgaccccgtggggacccacggggaaccctgggaccaccgggtctcctcacgccctccgaccgacggcccagtccggtccctccccgtgggccctcccgttgccttccgacggcgcccgttccgttccgaagcgccncgacggcccggtcccgttggggcccg

SEQ ID NO: 399609 - DNA, 568 bp, Homo sapiens
  misc_feature: GZ8MTXP01C9FYY.19.86.H09.1.454.CMB.2.raw
  modified_base (196)..(196): a, c, t, g, unknown or other
  modified_base (360)..(360): a, c, t, g, unknown or other
  modified_base (371)..(371): a, c, t, g, unknown or other
  modified_base (396)..(396): a, c, t, g, unknown or other
  modified_base (536)..(536): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtgcgcatacgtcgcacagaagttcgagggccgcgtcaccatggccaaggtcgcgtccagaatacagtgtatagtggacttgagcagcctgacggtctgacgacacggcntgtattattgngcgagcgagggacgggactaaaggntaataaagtcggttaccgacccgtcgggccgaacgggaccctagtccgacgtctccgtcacgcctacccaccgacggcccacgtccgtcccgtccccgtggcccgcccgttgcccttccgacggcgccgccttccggaanacgcgaccgacggccggtcccgttcgggtccg

SEQ ID NO: 399610 - DNA, 600 bp, Homo sapiens
  misc_feature: GZ8MTXP01C6ABE.19.86.H09.1.454.CMB.2.raw
  modified_base (181)..(181): a, c, t, g, unknown or other
  modified_base (196)..(196): a, c, t, g, unknown or other
  modified_base (363)..(363): a, c, t, g, unknown or other
  modified_base (374)..(374): a, c, t, g, unknown or other
  modified_base (407)..(407): a, c, t, g, unknown or other
  modified_base (504)..(504): a, c, t, g, unknown or other
  modified_base (512)..(512): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattancatatactctgggtncgacaggcccctggacaagggcttgagtggatagggcgatccgaggtggtagtggtgcgcatacgtcgcacagaagttcagggccgcgtcaccagtcggaccaaggtcgcgtaccacgaatacagtgtatagtggacttgagcagcctgaggtctgacacaacggcntgtattatgtncgagcaggacgggactaaagggcaagttaaagnggtccgacccgtgggccaagggaccctggtccaccgggtctccctcacgccctacccgaaccgtaacggcccctacgtcccgttccccttcccccgngggtcccncccgttcgtcccgttccgaacgggtaacgcccgttaccgcccgaagcgaaccgaacgcgggttccccgggccccgttgggggtccccg

SEQ ID NO: 399611 - DNA, 538 bp, Homo sapiens
  misc_feature: GZ8MTXP01BU4CI.19.86.H09.1.454.CMB.2.raw
  modified_base (279)..(279): a, c, t, g, unknown or other
  modified_base (506)..(506): a, c, t, g, unknown or other
  modified_base (511)..(511): a, c, t, g, unknown or other
  modified_base (518)..(518): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatcaggtggtagtggtgcgcatacgtcgcacagaagttcagggccncgtcaccatggccaaggtcgcgtccacgaatacagtgtatatggacttgagcagcctgaggtctgacgacaacggccaatgtattattgtgcgaggcaggacggggctaaagggcaataaagtgggttacgaccccgtggggccagggaacccctggtcaccggggtctcctcagcctccgaccgaaggcccatccggtcctcccctggccgccttgcttccgagcncgccnccgaagngcacgagcgcccgttgggcc

SEQ ID NO: 399612 - DNA, 515 bp, Homo sapiens
  misc_feature: GZ8MTXP01ET5LH.19.86.H09.1.454.CMB.2.raw
  modified_base (355)..(355): a, c, t, g, unknown or other
  modified_base (505)..(515): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagcttccctggccatcagaggggctccagtctagagatgaggctgattattactgtcgcaatcgtggactagacngtgtggaacgggttccgggttttacgggcgggtagggaccaagctcgacgtctaagtcagcgcaagctcgcccctagtccactcttcgtccctcccctcctcccgacgacgacgtaacgtcgaggcgggcgtggcgacggcgcgagtagnnnnnnnnnnn

SEQ ID NO: 399613 - DNA, 578 bp, Homo sapiens
  misc_feature: GZ8MTXP01A6174.19.86.H09.1.454.CMB.2.raw
  modified_base (351)..(351): a, c, t, g, unknown or other
  modified_base (363)..(363): a, c, t, g, unknown or other
  modified_base (570)..(570): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacagaagttcagggccgcgtcaccagtcggccaaggtccgcgtccaacgtaatacagtgtatagtggacttgagcagcctgagtcngacgacaacgcntgtattatgtgcggagcgagggacggcgtaaaggcaagtaaggtcggtaccgacccggtcggggccgacgggaccctggtccaccggtctcctccacgccctaccgaccgacggccctacgtcccgtaccttcccccgtcggcccgtcccttcgccttccgacggccgccgttccgcccggaagacggccacgcggcccggtcccgngggtcccg

SEQ ID NO: 399614 - DNA, 559 bp, Homo sapiens
  misc_feature: GZ8MTXP01AONJL.19.86.H09.1.454.CMB.2.raw
  modified_base (300)..(300): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtgcgcatacgtcgcacagaagttcagggccgcgtcaccatggccaaggtcncgtccacgaatacagtgtatatggacttgagcagcctgaggtctgacgacacggccaatgtattattgtgcgaggcagggacgggactaaaggcaagtaaagtgggttcgacccgtggggccagggaaccctggtccaccgggtctcctcgacgcctccgaccaacgggcccacgtccgggtccttcccccgtggcccgccccttcgccgttcccgaggcgccgaccttccgaagacgcacacggccgccgttgggccg

SEQ ID NO: 399615 - DNA, 577 bp, Homo sapiens
  misc_feature: GZ8MTXP01EDUJL.19.86.H09.1.454.CMB.2.raw
  modified_base (361)..(361): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggcccgcgtcaccatggccaaggtcgcgtccacgaatacagtgtatatggacttgagcagcctgaggtctgacgacaacggcntgtattatgtgcgaggcagggaggggctaaaggcataaagtggttacgaccccgtggggccagggacctgggtccaccgggtctcctcacgccctccaccgtaacgggccctacgtccggtcccttcccccgtggcccgtccccttggcccttcccgagggcgcccgttccgttcccggaagacgccacggacggccgggtccccgttggggtccc

SEQ ID NO: 399616 - DNA, 613 bp, Homo sapiens
  misc_feature: GZ8MTXP01DDWPK.19.86.H09.1.454.CMB.2.raw
  modified_base (603)..(613): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaaccggcccccaaatcgtcatctaataatgacgctgagcggtccttaagggtccctgaccgtattctctggcgagaggtctggcgcctcagtccttcccgtggccatcgagacgggctccgagtctagaagagtgaggcttagtatttacttactgtcgactaagtcgtggggataagacgtggttgggtacggttaaacggggtttccgggtttacggcgttagggaacgggaccgtaagtccgtacgtacccgtacgtacgtacgacggtcgacgacggtccctccggtaccccgtcggtacctacccgttccgttacccgtaccccctaccccttcccgtacccgaacggtacgtacgttaccgaggacgggccgggtcgcgggacgaacggcgacgtagagnnnnnnnnnnn

SEQ ID NO: 399617 - DNA, 566 bp, Homo sapiens
  misc_feature: GZ8MTXP01AFDVX.19.86.H09.1.454.CMB.2.raw
  modified_base (368)..(368): a, c, t, g, unknown or other
  modified_base (386)..(386): a, c, t, g, unknown or other
  modified_base (412)..(412): a, c, t, g, unknown or other
  modified_base (434)..(434): a, c, t, g, unknown or other
tcagtactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggtcttttggatacaccttcagtcattatcatatactcgtgggtgcgacaggcccctggacaagggcttgagtgatagggcgatccaggtggtagtggtgcgcatacgtcgcacagaagtttcgacgggccgcgtcaccatcgggccaaggtcncgtccaacgaatacagtntatatggacttgagcagctgagtcgngcgacgcgctatgtattagtgngcggaggcgaggggtacgggtaacgtaaaggctaaagtaacggttcggtacccggacccggtcggggacccgacggggttacccttcggtccacccgtcctcccgtacgaccgtcccgttaacccgaacccg

SEQ ID NO: 399618 - DNA, 709 bp, Homo sapiens
  misc_feature: GZ8MTXP01A6O25.19.86.H09.1.454.CMB.2.raw
  modified_base (327)..(327): a, c, t, g, unknown or other
  modified_base (341)..(341): a, c, t, g, unknown or other
  modified_base (697)..(697): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtaggtggtggcgcatacgtcgcacagaagttcgagggccgcgtcaccatcggccgaaggtcggccgtccacgaatacagtntatatgacttgagnacgcctggaggtctgacgacaacgggcctaatgttaattacttggtggcgtagggcgagggacggggactaaaggacaagtaaaggtcgggttacgaccccggtgggggaccacggggaaaccccgtgggttaccgacccggttacccgtccctacccgaacggccccttaccccgaaacccgaaccgggggtcccccaacgttccccggggttccccttcccccccggttcgggccccggccccccgtttcgggaaaccccttccccgggaaacggggtcccgttacccgttacccccgttacccgggaacgaccggaacccaaacccgggttcggccccgggggttcccccggngggggtccccgg

SEQ ID NO: 399619 - DNA, 598 bp, Homo sapiens
  misc_feature: GZ8MTXP01BXX7T.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccgaggtggtagtggtggcgcatacgtcgcacagtaagttcagggcccgcgtcaccatcggccaaggtcgcgtccacgaatacagtgtatatggacttgagcagcctggacggtctgaaccgacgaaccgggcctaagttgtatttagttgtgcggaggcgagggacgggactaaaggctaagtaaaggtcggtacgaccccgtggggaccacgggaaccctggtccaccggtctcctcgacgccctccgaccgaacggcccacgtcccggtcccttccccgcggcccgtccccgttgcccttccgacggccgcccgccgttccggaagcgcaccgacggcccggtccgttcggggtcccg

SEQ ID NO: 399620 - DNA, 575 bp, Homo sapiens
  misc_feature: GZ8MTXP01CXIN4.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggataggggcgatccgagggtggtagtggtggcgcatacgtcgcacagaagttcgagggcccgcgtcaccatggccaaggtcgcgtccacgaatacagtgtatatggacttgagcagcctgaggtctgacgacaacggcaatgtattagttgtgcggagcgagggacggggataaaagggcaaagttaaacggtgggttaccgaccccgtggggacccgacgggaaccctgggtccaccgggtctccctcaacgccctccgaccgacgggcccagtccggtccttccccgtgccgcccttgccttccgagcgccgccttccgaagacgccacgcggccgcccgttgggccg

SEQ ID NO: 399621 - DNA, 540 bp, Homo sapiens
  misc_feature: GZ8MTXP01DYZAR.19.86.H09.1.454.CMB.2.raw
  modified_base (365)..(365): a, c, t, g, unknown or other
  modified_base (427)..(427): a, c, t, g, unknown or other
  modified_base (430)..(430): a, c, t, g, unknown or other
  modified_base (523)..(523): a, c, t, g, unknown or other
  modified_base (536)..(536): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgatacagtgtatatggacttgagcagcctgaggtctgacgacacggccatgtattattgtgcgaggcaggacgggacctaaaggcaagtaaagtggttacgacccngtggggccagggaacccctgggcaccgtctctcagcctccacaagggcccatcgtcctcccngcncctgctcgagcgcacctccgagacgcacgtcgccggccctggggctcgccgttgggacaacgggtacttccgttcccacgaagacgttaacgnggacggcggtcgnggcg

SEQ ID NO: 399622 - DNA, 571 bp, Homo sapiens
  misc_feature: GZ8MTXP01C1D4O.19.86.H09.1.454.CMB.2.raw
  modified_base (334)..(334): a, c, t, g, unknown or other
  modified_base (363)..(363): a, c, t, g, unknown or other
  modified_base (541)..(541): a, c, t, g, unknown or other
  modified_base (549)..(549): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgagtggtagtggtggcgcatacgtcgcacagaagtcagggccgcgtcaccatggccaaggtcgcgtccacgaatacagtgtatattggacttgagcngcctcggaggtctgaccgacaacgggccnttgtattagttgtgcggaggcgagggacggggacgtaaaggcaataaaggtgttccggacccgtcggggacacgggacctgggtcaccggggtctccgtaccagcccgtacccaccgaaacgggtcccacgtccggttcccttccccgtggcgcccccttggccttccgacggcgccnccttccgnacgcacgcgccgccgttgggcg

SEQ ID NO: 399623 - DNA, 609 bp, Homo sapiens
  misc_feature: GZ8MTXP01EA02E.19.86.H09.1.454.CMB.2.raw
  modified_base (360)..(360): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacaacggcntgtattattgtgcggaggcgagggacgggactaaaggcaagtaaaggttcggttaccgaccccgtggggaccgacgggaacccgtgtccaccggggtctccgtcacgccctccgaccgaacggaccctacgtcccggtcccttcccccgtggcccgtccccgttcgtcccgttcccgaacgggcgacccgacccgttacccggaacggacgccgaccggaccggcccgggtccccgttgggggtccccg

SEQ ID NO: 399624 - DNA, 576 bp, Homo sapiens
  misc_feature: GZ8MTXP01CT1HL.19.86.H09.1.454.CMB.2.raw
  modified_base (135)..(135): a, c, t, g, unknown or other
  modified_base (196)..(196): a, c, t, g, unknown or other
  modified_base (339)..(339): a, c, t, g, unknown or other
  modified_base (365)..(365): a, c, t, g, unknown or other
  modified_base (376)..(376): a, c, t, g, unknown or other
  modified_base (520)..(520): a, c, t, g, unknown or other
  modified_base (572)..(572): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctnagtgaaggtctcctgcgaggcttttggatacaccttcagtcattatcatatactctgggtncgacaggcccctggacaagggcttgagtggatagggcggatccgaggtggtagtggtgcgcatacgtcgcacagaagttcagggcccgcgtacaccagtcggaccaaggtccgcgtaccaagaatacagtgtatatgattgancagctgaggtctgacactaacggccntgtattattgngcggagcgaggacgggactaaaggcaagtaaagtggttaccgacccgtaggggccaacgggaaccctggtccaccgggtctccgtacacgccctacccacgacgggacccagtcccggtccctcccccgtgcccgtccccgttnaccttccgacgacgccaccgttccgaagacgccaacgcgttccgtccccggnggtc

SEQ ID NO: 399625 - DNA, 530 bp, Homo sapiens
  misc_feature: GZ8MTXP01ETJJC.19.86.H09.1.454.CMB.2.raw
  modified_base (259)..(259): a, c, t, g, unknown or other
  modified_base (338)..(338): a, c, t, g, unknown or other
  modified_base (374)..(374): a, c, t, g, unknown or other
  modified_base (378)..(378): a, c, t, g, unknown or other
  modified_base (440)..(440): a, c, t, g, unknown or other
  modified_base (447)..(447): a, c, t, g, unknown or other
  modified_base (478)..(478): a, c, t, g, unknown or other
  modified_base (484)..(484): a, c, t, g, unknown or other
  modified_base (494)..(494): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccgaggtggtagtgggtggcgnatacgtcgcacagaagttcgaggccgcgtcaccatggccaaggtcgcgtccaacgaatacagtgtatagtggacttgancagctgaggtctgacacaacgcaatgtatattgcgngagnaggacgggacaaaggcaataaagtggttacgacccgtgggccaggaacctgtcacggtctcncacgccnccacaacggccagtcgtcctcccctggcccnccttcncaccgaggcnccaccgcgaagacaacgacgacgccggtccgcggcg

SEQ ID NO: 399626 - DNA, 768 bp, Homo sapiens
  misc_feature: GZ8MTXP01EU1JG.19.86.H09.1.454.CMB.2.raw
  modified_base (163)..(163): a, c, t, g, unknown or other
  modified_base (355)..(355): a, c, t, g, unknown or other
  modified_base (754)..(755): a, c, t, g, unknown or other
  modified_base (761)..(761): a, c, t, g, unknown or other
  modified_base (763)..(763): a, c, t, g, unknown or other
  modified_base (766)..(766): a, c, t, g, unknown or other
  modified_base (768)..(768): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcaagaaacgtcccaggaaccggcccccaaatcgtcatctataatgacgctgagcggtccttaagggtccctgaccgattctctggcgagaggtctggcgcctcagccttcccgtggccatcgaggacgggctccgagtctagaacgagtgaggtctgtatttattactgtacnctaatcgtgggatagacgtggttggtacgggtaacccggggtttccggggttttacggggacggggtaaacggggtaaccctaaacgggtccgttaacgggtaaccccggttacccgttaaacgggttcccgaaacccgggtacccccggtaaacggggtccccgttaccccggtccccccccgttacggggttaccccttaaccccgtttacccgggtttccccggttttaacccccccctaacccccgtttcccccgtttaaccccggaaacccgggtaaccggttaaccggttaaacccggttcggggaacccgggggtacccgggggtccggttaccggggaaaccggtaaaccgggggttcccgaaccggttaacggtaacgggcgacgcgcgnngcgcgngntgngn

SEQ ID NO: 399627 - DNA, 791 bp, Homo sapiens
  misc_feature: GZ8MTXP01BNUFN.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgatccgaggtggtagtgggtggcgcatacgtcgacacgagtaagttcgagggccgcgtacaccgagtcggaccaaggtccgcgtaccaacgaatacgagtgtatagtggtacttgagcgagtccgtggacggtctaggaccgacgaaccggtccaagttgttaatttagttggtacggacggaggggaccgaagggggaacggggaacgttaaaagggccgtaaaggttaaacgggttacgggttacccgggaccccggttggggggaccccgtaaacgggggtaaccccgttcggggtaccccgttaacccggggttcccttaccccgttacccgaacccgggttacccctaaccccgaaaccccgggaaaccggggttacccccgtaacgttcccccgggttcccccgttttccccccggcgggtcccccgtcccccgttaccggccccgttaacccgggtaaccgggaccggttaccccgaccccgttacccgggaacggtaccggcccgtaaaccggcccggggccccgggttcccgggttccgggtcccggg

SEQ ID NO: 399628 - DNA, 607 bp, Homo sapiens
  misc_feature: GZ8MTXP01AG3ZI.19.86.H09.1.454.CMB.2.raw
  modified_base (350)..(350): a, c, t, g, unknown or other
tcagtactctcgtgcacgaccggtgctcgattttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacacggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtcngacgacaacggcctgtgtattattgtgcggaggccgagggacggggacgtaaagggactaagtaaaggttcgggttaccgaccccggtcggggacccgacgggaacccgtggtacccgaccgggttctcccgtcacgccctacccgaccgaacggggcccctacgttccccggttcccttcccccgtcgggcccgcccgttcgccgttccgacggcgccgcccgttccgaagacgcacgacggccgtccgcggtccg

SEQ ID NO: 399629 - DNA, 593 bp, Homo sapiens
  misc_feature: GZ8MTXP01AYVPQ.19.86.H09.1.454.CMB.2.raw
  modified_base (286)..(286): a, c, t, g, unknown or other
  modified_base (521)..(521): a, c, t, g, unknown or other
  modified_base (526)..(526): a, c, t, g, unknown or other
  modified_base (548)..(548): a, c, t, g, unknown or other
tcagtactctcgtgcacgaccggtgctcgatttagtgctatagacttgggtttgggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgagggtggtagtggtggcgcatacgtcgcacagaagttcgagggccncgtcaccatcggccaaggtcgcgtccaagaatacagtgtatatggacttgagcagcctggacggtctaggaacgacgaacggcctaatgttagttagttggtgacgggagggacgaaggggacgggtacgtaaagggctaagtaaaggtcggttaccgacccgtggggaccacgggaaccctggtaccacggtctcctcacgcctaccaccgacggccagtcccggtcctcccgnggccncccgttgccttccgaggtaccnccgacccgttccgaagcgccgacgacggccggccgttgggtcccg

SEQ ID NO: 399630 - DNA, 806 bp, Homo sapiens
  misc_feature: GZ8MTXP01AEEAU.19.86.H09.1.454.CMB.2.raw
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggcttttggatacaccttcagtcattatcatatactcgtgggtgcgacacggccctggacaagggcttgagtggatagggcgatccgaggtggtagtggtgcgcatacgtcgcacaggtaagttcgagggccgcgtcaccgagtcggaccaaggtccgacgttaccaacggtaatacgagttgtatagtcggaacttggaagcacggccgttacggacggttctcggaaccggacgaaacccgggcctaagtttggttaagtttagtttgggtacggacgggaacgggaccggaacgggggtaaccgggggtaacgttaaaaacggggaccgtaaaagttaaaacggggttcggggttaaccccggtaaaccccgggttcggggggaacccgaaacggggggtaaacccccgttcggggttacccgaaccccgggggttcttaccccgttaccgaacccggtaccccgtaccccggaaacccggtaaaccgggggtcccctaacggtttccccgggttccccctttccccccggtcggggccccgtccccgttcggaccccgttacccggaacgggttacccgccccgttaccccgacccggaaacggccgaaccgaaccggtcgggccccgggtccccgttaagggggtccccg

SEQ ID NO: 399631 - DNA, 709 bp, Homo sapiens
  misc_feature: GZ8MTXP01BA5SB.19.86.H09.1.454.CMB.2.raw
  modified_base (135)..(135): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctnagtgaaggtctcctgcgaggtcttttggatacaccttcagtcattatcatatactcgtgggtgcgacacggcccctggacaagggcttgagtggagtagggcgatccgaggtggtagtggtggcgcagtacgtcgcacgagtaagttcgacgggccgcgtcaccagtcggaccaaggtccgcgtccacgaatacagtgtatatggattgagcagcctgaggtcagacgacgaaccggcctaagtagttatttagttgtaggcggaggtacgaaggggacggggtaactaaacggactaaagttaaacggtcgggtttacccgaccccggtcggggacccgaaccgggtaacccgtacgggtacccgtaacccggggtcctacccgttaccgacccggtccccgttaccccgaacccggaacccgggtacccccgtaaccggttccccgggttccccgttcccccccgtcgggtccccgccccgttccgccccgttacccgacgggtacccgacccgacccgacccggaacgaccgaaccgaccgacggccccgggtcccgttcggggtccccgg

SEQ ID NO: 399632 - DNA, 598 bp, Homo sapiens
  misc_feature: GZ8MTXP01EY0BZ.19.86.H09.1.454.CMB.2.raw
  modified_base (320)..(320): a, c, t, g, unknown or other
tcagtactctcgtgcacgaccggtgctcgatttagtgctatagacttgggtttgggggggaagaggaagactgacggccccactcccaggtgcagctggtgaagtctggggctgaggtgaaggagcctggggcctcagtgaaggtctcctgcgaggcttttggatacaccttcagtcattatcatatactctgggtgcgacaggcccctggacaaggcttgagtggatagggcgatccaggtggtagtgggtggcgcatacgtcgcacagaagtttcagggcccgcgtcaccagtggccaaggtcgcgtccacgaatacngtgtatatggacttgagcagcctgacggtctgacgacacggcatgtatatgtgcgaggcagggacggggataaaggctaagtaaagtggttaccggaccccgtggggaccgaacggggaccccgtagggtccgacccgtcctcctcgacgcccctccaccccgaaacgggccccgtacgtcccggtcccttccccccgtcgggtcccgccccgtcgcctccgacggcgtccacccgttccgacggaacgcaacgcggccggcccgtcgggcgtccggg

SEQ ID NO: 399633 - DNA, 563 bp, Homo sapiens
  misc_feature: GZ8MTXP01BL9KE.19.86.H09.1.454.CMB.2.raw
  modified_base (283)..(283): a, c, t, g, unknown or other
  modified_base (303)..(303): a, c, t, g, unknown or other
  modified_base (496)..(496): a, c, t, g, unknown or other
  modified_base (521)..(521): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccncgtcaccatggccaaggtcncgtccagaatacagtgtatatggacttgagcagcctgaggtctgacgacaacggccaatgtattatgtgcggaggcgagggacggggactaaaggcaagtaaaggtggttccgacccgtggggaccagggaaccctggtccaccgggtctcctcacgcctcacccgaagggccccagtccggtcccttccccnggccgcccttgcccttccgacggcncccgccttccgaagcgccacgcgccgggtcccgttgggcccg

SEQ ID NO: 399634 - DNA, 651 bp, Homo sapiens
  misc_feature: GZ8MTXP01DVJ2U.19.86.H09.1.454.CMB.2.raw
  modified_base (259)..(259): a, c, t, g, unknown or other
  modified_base (393)..(393): a, c, t, g, unknown or other
tcagtactctcgtgcacgaccggtgctcgatttagtgctatagacttgagtttggggggaagaggaagactgacggccccactcccaggtgcagctggtgcagtctggggctgaggtgaaggagcctgggcctcagtgaaggtctcctgcgaggtcttttggatacaccttcagtcattatcatatactctgggtgcgacacggcccctggacaagggcttgagtggagtagggcggatccgaggtggtagtggtggcncatacgtcgcacagaagtttcgagggccgcgtcaccagtcggaccaaaggtcgcgtccaacgaatacgagtagtatagtggacttgagcagcccctggagtctgacgaacgacggccatgttattattggtcgngaggcgaggggacggggacgtaaaagggctaagtaaaacggttcgggttaccgaccccggtacggggacccgaacggggaaccccgtcgggtaccgaccccggtttctccccgtcgaaccgccccgttacccgaacccgaaaccgggcccctacggttcccggttcccgttcccccgtcggcccgccccgttacgccgtacccgacggttacgccccaccgtcccgaagccgaccgacgcggtcccggcccgtcgggg

SEQ ID NO: 399635 - DNA, 684 bp, Homo sapiens
  misc_feature: GZ8MTXP01AVWUL.19.86.H09.1.454.CMB.2.raw
  modified_base (123)..(123): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggngcctggggcctcagtgaaggtctcctgcgaggcttttggatacacctttcagtcattatcatatactctgggtgcgacacggcccctggacaagggcttgagtggatagggcgatcgaggtggtagtggtggcgcatacgtcgcacagtaagttcgagggccgcgtacaccgagtcggaccgaaggtccgccgtaccgaacgaatacgagtagtaatagtggtacttgagcgacgtccgtaggacggtctagaccgacgacgggacctaagttgtaatttagtggtcgacgggaggcggaggggacgggataaaggactaagttaacggttcgggtacccgacccgggtcggggacccgacgggtaacccgtcggtacccgtaccgggttcctcccgtacgacccgtccctacccgaccgaaccgggccctacggtccccggttccccttccccggcggccccgtccccgcggtcccgttaccggacgggaaccgcccgttacccggttaccgaacggaccgaaccgacggccggccccgggtcccggttgggtaaccccg

SEQ ID NO: 399636 - DNA, 659 bp, Homo sapiens
  misc_feature: GZ8MTXP01BG7PT.19.86.H09.1.454.CMB.2.raw
  modified_base (135)..(135): a, c, t, g, unknown or other
  modified_base (262)..(262): a, c, t, g, unknown or other
  modified_base (293)..(293): a, c, t, g, unknown or other
  modified_base (400)..(400): a, c, t, g, unknown or other
  modified_base (507)..(507): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctnagtgaaggtctcctgcgaggcttttggatacaccttcagtcattatcatatactcgtgggtgcgacacggcccctaggaacaagggcttgagtggagtagggcgatccgagggtggtagtggtggcncatacgtcgcacgagtaagttcgagggccgngtcaccagtcggccaaggtcgcgtccaacgaatacagtgtacagtggtacttgagcagcctggaggttcagaccgacgtaaccggcctaatggtaaatttgttcggngacggaggacgacggggacggaacggtaaacggactaagtaacggttcggtacccggacccggtacggggaccgaacgggtaccgtcgtaccgtcccggtcctcccncgacccgtcccacccgaaccgaccggcccgtaccgttccccgttccccgttccccggtcggccccgtacccgttccgaccgttaccggacggaccgcccgacccgttccggaacgccgaaccgacgtccgggcccggtccggttcgggtccg

SEQ ID NO: 399637 - DNA, 526 bp, Homo sapiens
  misc_feature: GZ8MTXP01AV0VB.19.86.H09.1.454.CMB.2.raw
  modified_base (317)..(317): a, c, t, g, unknown or other
  modified_base (511)..(511): a, c, t, g, unknown or other
  modified_base (515)..(526): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtcttaagggtccctgaccgattctcgtggcgagaggtctggcgcctcagcttccctggccatcagagggctccagtctgaagntgaggctgattatactgtcgcaatcgtgggatgactgtgtaggtaacgggttccggtttgggacgggtagggaccaagctacggaccgtactaagtcacggcccaaggcctcgccccgtggtcctaccgtctcgttccccaccctcctaccacgacgacgtaccgtggacggcgggcgtggaacgaaggcgacngagnnnnnnnnnnnn

SEQ ID NO: 399638 - DNA, 602 bp, Homo sapiens
  misc_feature: GZ8MTXP01ALTH4.19.86.H09.1.454.CMB.2.raw
  modified_base (123)..(123): a, c, t, g, unknown or other
  modified_base (540)..(540): a, c, t, g, unknown or other
  modified_base (561)..(561): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggngcctggggcctcagtgaaggtctcctgcgaggcttttggatacaccttcagtcattatcatatactcgtgggtgcgacaggcccctggacaagggcttggagtggatagggcgatccgagggtggtagtggtgcgcatacgtcgcacagaagttcgagggccgcgtcaccatcggccaaggtcgcgtccagaatacagtgtatatggacttgagcagtccgtggacggtctagaccgacgaaccgggcctaagttgttaatttagttggtggcggaggacgaggggacgggggacttaaagggctaagtaaaggtcgggttaccgacccgtggggccacgggaaccctggtccaccggtctccctcgacgccctccgaccgaacggccctacgtccgggtcccttccccgcggcccncccgttcgccttccgacggcnccgccgttccgaagcgccacgcggccggtccgttgggcccg

SEQ ID NO: 399639 - DNA, 586 bp, Homo sapiens
  misc_feature: GZ8MTXP01EMPSZ.19.86.H09.1.454.CMB.2.raw
  modified_base (351)..(351): a, c, t, g, unknown or other
  modified_base (364)..(364): a, c, t, g, unknown or other
  modified_base (516)..(516): a, c, t, g, unknown or other
  modified_base (543)..(543): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccgaggtggtagtggtgcgcatacgtcgcacagaagttcgagggccgcgtcaccatcggccaaggtccgcgtccacgaatacagtgtatagtggacttgagcagcctgaggtcngacgacaacggcntgtattattgtgcggaggcgagggacggggactaaagggcaagtaaaggttcgggttaccgaccccggtggggacccacgggaccctggtccaccgggtctccgtcacgccctacccgaccgaacggccctacgtcccggtccttcccccgnggcccgtccttcgccttccgacggacnccgaccttccggaagacgcacgcggccggtccgttcgggtccg

SEQ ID NO: 399640 - DNA, 633 bp, Homo sapiens
  misc_feature: GZ8MTXP01CL5EJ.19.86.H09.1.454.CMB.2.raw
  modified_base (196)..(196): a, c, t, g, unknown or other
  modified_base (255)..(255): a, c, t, g, unknown or other
  modified_base (336)..(336): a, c, t, g, unknown or other
  modified_base (366)..(366): a, c, t, g, unknown or other
tcagtactctcgtgcacgaccggtgctcgatttagtgctatagacttgggtttggggggaagaggaagactgacggccccactcccaggtgcagctggtgcaatctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtgcncatacgtcgcacagaagttcagggccgcgtcaccagtcggccaaggtccgcgtccacgaatacagtgtatatggacttgancagcctcgacggtctggacacaaccgggcntgtattagtgtgcggaggcgagggacgggacgtaaaggctaagtaaaggtcgggttaccgaccccggtgggggaccacggggtaaacccgtggtccaccgggttctcccgtacgaccgtccctaccgaccgaacggggcccctacgttcccggttccccttcccccgcggtcccgtccccgttgccccgttcccgaacgggtaccgcccgacccgttaccggaaggaccgaaccaccggacggcccgggtcccggttcgggtcccgg

SEQ ID NO: 399641 - DNA, 600 bp, Homo sapiens
  misc_feature: GZ8MTXP01BQNXP.19.86.H09.1.454.CMB.2.raw
  modified_base (329)..(329): a, c, t, g, unknown or other
  modified_base (552)..(552): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtctttttggatacaccttcagtcattatcatatactctgggtgcgacaggcccctggacaagggcttgagtggatagggcgatccgaggtggtagtggtggcgcagtacgtcgcacagtaagttcgagggccgcgtcaccagtcggaccaaggccgcgtaccacgaatacagtntatatggacttgagcagcctgaggtctagacgacaacgcaatgtattatgtgcggagcgagggacgggactaaaggacaagtaaagtcgggttaccgacccggtcggggaccgacgggaacccgtggtccgaccgggtctcctcaccgccctacccgaccgaacggtcccacgtcccggttcccttccccgtcggcccgtcccgttcgtccttccgacggacncccgacccgttccgaacgacgcaccgcggccggtcccgttcgggtccg

SEQ ID NO: 399642 - DNA, 572 bp, Homo sapiens
  misc_feature: GZ8MTXP01AEOJL.19.86.H09.1.454.CMB.2.raw
  modified_base (362)..(362): a, c, t, g, unknown or other
  modified_base (531)..(531): a, c, t, g, unknown or other
  modified_base (565)..(565): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggataggggcgatccgaggtggtagtggtggcgcatacgtcgcacagaagttcagggccgcgtcaccatggccaaggtcgcgtccacgaatacagtgtatatggacttgagcagcctgaggtctgaccgcaacggccntgtattattgtgcgaggcgagggacggggactaaaggcaagtaaaggtcggttacgacccgtggggccgaggggaaccctggtccaccgggttctcctcacgccctccgaccgaacgggcccacgtccggtccttcccccgtggcccgcccgttcgccttccgacggcnccgccgttccgaagacgcacgacgccggtcccgnggtcccg

SEQ ID NO: 399643 - DNA, 636 bp, Homo sapiens
  misc_feature: GZ8MTXP01CXF1W.19.86.H09.1.454.CMB.2.raw
  modified_base (321)..(321): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtgcgacaggcccctggacaagggcttgagtggatagggcgatccgaggtggtagtggtgcgcatacgtcgcacagaagttcgagggccgcgtcacatcggccaaggtcgcgtccacgaatacagtntatatggacttgagcagcctggaggtctgaaccgacgaaccggccaagttgttaattagttggtggacgggagggcgaaggggacggggtaactaaagggcaagttaaacggtcgggttacccggaccccggtgggggacccgacggggtaacccgtggtacccgaccgggttctcccgtccgacgccctacccgaccgaacggccccacgtcccggtcccttcccccgtggccccgtcccgttcggtcccgttccgacgggcgcccgcccgttcccggaagacgccgacgacggccggtcccgttcgggtcccg

SEQ ID NO: 399644 - DNA, 546 bp, Homo sapiens
  misc_feature: GZ8MTXP01EZLSN.19.86.H09.1.454.CMB.2.raw
  modified_base (359)..(359): a, c, t, g, unknown or other
  modified_base (505)..(505): a, c, t, g, unknown or other
  modified_base (513)..(513): a, c, t, g, unknown or other
  modified_base (519)..(519): a, c, t, g, unknown or other
  modified_base (526)..(526): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacacacggcntgtattatgtgcggaggcagggacgggctaaaggcaagtaagtggtccgacccgtggggccacgggaaccctgccacgggtctcgtcacgcctccaccgacggcccagtccgtcctccccgtggccgtcccttgccttccgaggcnccgttccnccgaanacgcacncggttccggccgttgggccg

SEQ ID NO: 399645 - DNA, 524 bp, Homo sapiens
  misc_feature: GZ8MTXP01DTS2J.19.86.H09.1.454.CMB.2.raw
  modified_base (296)..(296): a, c, t, g, unknown or other
  modified_base (433)..(433): a, c, t, g, unknown or other
  modified_base (515)..(515): a, c, t, g, unknown or other
tcagtactctcgtgcacgaccggtgctcgatttagtgctatagacttgggtttggggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccagcagtgatgtagaaattctaacttgtctctgtacacatcaaccaaataacgccccaaactcatacatttangactgaccactaagccggtacctcgtagggtttctaatcgctttcctctgctcaagtctggcaacacgcctccctgacaatctcgtcggactccaggctagacggacgaggctgattactactgctggtctcaagtngtcaggttctatcttcttattcggtcttcggacgtcgggacaggttccaccgttcaggtcaagcccaacggcccaacccgtnttcgtaacc

SEQ ID NO: 399646 - DNA, 582 bp, Homo sapiens
  misc_feature: GZ8MTXP01EOUSV.19.86.H09.1.454.CMB.2.raw
  modified_base (284)..(284): a, c, t, g, unknown or other
  modified_base (364)..(364): a, c, t, g, unknown or other
  modified_base (517)..(517): a, c, t, g, unknown or other
  modified_base (540)..(540): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagtaagtcgagggccncgtcaccagtcggccaaggtcgcgtccaacgaatacagtgtatagtgacttgagcagcctgagtctgacgacaacggctntgtaattagttgtgcgagggcgagggacgggtacaaaggctaagttaaaggtcgggttaccgaccccggtggggaccgacgggtaaccctggtccctaccggggtctccgtcacgccctaccgaccgaacggcccagtccggtccctccccgnggccgcccttgccttccgaggcnccgccgttccgaagcgcacgacggccgtcccgttgggtcccg

SEQ ID NO: 399647 - DNA, 620 bp, Homo sapiens
  misc_feature: GZ8MTXP01CG99V.19.86.H09.1.454.CMB.2.raw
  modified_base (305)..(305): a, c, t, g, unknown or other
  modified_base (348)..(348): a, c, t, g, unknown or other
  modified_base (362)..(362): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactcgtgggtgcgacaggcccctggacaagggcttgagtggataggggcgatccgaggtggtagtggtggcgcatacgtcgcacagaagttcagggccgcgtcacatggccaaggtcncgtccacgaatacagtgtatatggacttgagcagcctgaggtntgacgacacggccngtgtattattgtgcggaggcgagggacggggactaaagggcaagtaaaggtggttaccgaccccggtgggggcccacggggaaccctgggtaccacccggggttctccctaccaacccctccaccgaacgggcccacgttcccggtccctttcccccgtcgggcccgtccccttacgcccgttcccgagggtaaccgccgacccgttccggaacggcgcccgaacgccggccgggttcccgtcgggccgttcccgggg

SEQ ID NO: 399648 - DNA, 556 bp, Homo sapiens
  misc_feature: GZ8MTXP01BONS4.19.86.H09.1.454.CMB.2.raw
  modified_base (195)..(195): a, c, t, g, unknown or other
  modified_base (359)..(359): a, c, t, g, unknown or other
  modified_base (520)..(520): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtgtagtggtgcgcatacgtcgcacagaagttcagggccgcgtcaccatggccaaggtcgcgtccacgaatcagtgtatactggacttgagtcagcctgaggtctgacgacaacgggccngtgtattattgtgacgaggcagggacggggactaaagggcagtaagtggtaccgacccgtggggccacgggaaccctggtccaccgggtctacctcacgcctcccgaccgacgggcccacgtccggtccttccccgtgaaccgcccgttgccttccgagcncgccttccgaagacgctacaggccgccgttggggcc

SEQ ID NO: 399649 - DNA, 554 bp, Homo sapiens
  misc_feature: GZ8MTXP01CC5QP.19.86.H09.1.454.CMB.2.raw
  modified_base (361)..(361): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgaggtctgacgacaacgggccntgtattattgtgcgaggcagggacggggactaaagggcaagtaaagtggttacgaccccgtggggccagggaaccctggtcaccggtctcctcacgcctccaccgacggcccacgtccggtccttccccgtggccgcccttcgcttccgaggcgccgaccttccgaagcgcacgcgccggtcccgttgggccg

SEQ ID NO: 399650 - DNA, 557 bp, Homo sapiens
  misc_feature: GZ8MTXP01AGQF2.19.86.H09.1.454.CMB.2.raw
  modified_base (372)..(372): a, c, t, g, unknown or other
  modified_base (389)..(389): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcagggccgcgtcaccgatggccaaggtcgcgtccacgaatacagtgtatatggacttgagcagcctgaggtctgacgacaacggcaatgtattatgngcgaggcagggacgggntaaaggcaagtaaagtcggttcgacccgtggggccgagggaaccctggtcaccgggtctcctcgaacgccctccaaccgacgggcccactccggtcttcccccgtggccgcccttgccttccgacggcgcgccttccgaagacgcacgacggccggccgttcgggccg

SEQ ID NO: 399651 - DNA, 691 bp, Homo sapiens
  misc_feature: GZ8MTXP01AGBBG.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactcgtgggtgccgacacggccctggaacaagggcttggagtggagtagggcgatccgaggtggtagtggtggcgcagtacgtcgacacagtaagttcgacgggccgcgtccaccgagtcggaccgaaggtccgcgtccaacgaaatactagtcgtatagtcggtacttgacgcagcctggacggtctggaacgacgaacgccctaagttgtaatttagttggtggacgagggacgaggggacggggtaacgtaaaggcgaaagtaaacggtcgggtaccgaccccgggtacggggacccggtacgggtaacccgtcgggtaccacccggggttctcccgtaccgacgtccccgtaacccgaccggaaccggggtccccacgttcccgggttccccttccccccggtgggccccgtccccgttccgcccgttaccgacgggaacgcccgttacccggccggaacgaccgccgaacgtccgggccggtccccggttcgggtcccg

SEQ ID NO: 399652 - DNA, 766 bp, Homo sapiens
  misc_feature: GZ8MTXP01BKUSB.19.86.H09.1.454.CMB.2.raw
  modified_base (286)..(286): a, c, t, g, unknown or other
tcagtactctcgtgcacgaccggtgctcgatttagtgctatagacttgggtttgggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagtaagttcagggcccncgtcaccatcggaccaaggtcgcgtccaacgaatacagtgtatagtggacttgagcagccgtgaggtctaggacgacgaaaccgggcctaagtggttaatttagttggtggacgggaggggaccgaagggggacgggggtaacttaaaagggccgtaaagttaaaagggttacggggtttacccggaaacccccggttggggggaccccgaaacggggtaaaccccgttcgggtaacccgaacccgggggttcctttccccgtaccgaaccgggccccttaaccccgaacccggtaaaaccgggggccccctaacggttccccgggggttccccctttacccccccgttgggggccccccgtccccggtttacggacccccttcccggaaccgggggaaccccgttaccccgaccccggttacccgggaacggaccggaacccgaccggtaccgggccccgggtcccggttcgggtcccg

SEQ ID NO: 399653 - DNA, 581 bp, Homo sapiens
  misc_feature: GZ8MTXP01A8D03.19.86.H09.1.454.CMB.2.raw
  modified_base (361)..(361): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcgagggccgcgtcaccatggccaaggtcgcgtccacgaatacagtgtatatggtacttgagcagcctgaggtctgacgcaacggcngtgtattagtgtgcgagcgagggacgggataaaggcaagtaaagtcggttccgacccgtggggaccacgggaaccctggtcccaccggggtctccgtccgacgccctaccaacccgacggccctagtcccggtcccttccccgtgggcccgcccttggccttccgagggaccttccgccttccggaagcgcaacgcggccggtcccgttcggggaacccg

SEQ ID NO: 399654 - DNA, 584 bp, Homo sapiens
  misc_feature: GZ8MTXP01ABVOO.19.86.H09.1.454.CMB.2.raw
  modified_base (277)..(277): a, c, t, g, unknown or other
  modified_base (298)..(298): a, c, t, g, unknown or other
  modified_base (514)..(514): a, c, t, g, unknown or other
  modified_base (579)..(579): a, c, t, g, unknown or other
tcagtactctcgtgcacgaccggtgctcgatttagtgctatagacttgggtttgggggaagaggaagactgacgacccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtgatagggcgatccaggtggtagtggtgcgcatacgtgcacagaagttcagggccncgtcaccgatggccaaggtcncgtcagaatacagtgtatatggacttgagccagcctgaggtctagacgacaacgggcctaagtgtaattattgtggacgagggcagggacggggactaaagggcaagttaaaggtggtcaccccgtggggccagggtaaccctgggtccaacggggttctaccgtcgacgccctccgaccgaaacgggtcccaacgtccgggtacctttcccccgnggaaccgcccttcggccttcccgaagggacgttccaaccgttccgaagagcacacggcgttccgngggcc

SEQ ID NO: 399655 - DNA, 563 bp, Homo sapiens
  misc_feature: GZ8MTXP01ANVBD.19.86.H09.1.454.CMB.2.raw
  modified_base (272)..(272): a, c, t, g, unknown or other
  modified_base (441)..(441): a, c, t, g, unknown or other
  modified_base (540)..(540): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtanatggacttgagcagcctgagtctgacgacacggccatgtattattgtgcgaggcagggacggggactaaaggcaagtaaaggtcggttaaccgaccccgtgggcccagggaccctggtccacgtctacctcacgcctccacgaacgggcccagtccggtccttccccgnggccgccctgcctccggacggacgccacctccgagacgcacgacgtccggcctcgggctcgccgttggacacggacctacttcccgagagaacgtacgnggacgccgggctcggcgaacggg

SEQ ID NO: 399656 - DNA, 889 bp, Homo sapiens
  misc_feature: GZ8MTXP01A7814.19.86.H09.1.454.CMB.2.raw
  modified_base (293)..(293): a, c, t, g, unknown or other
  modified_base (302)..(302): a, c, t, g, unknown or other
tcagtactctcgtgcacgaccggtgctcgatttagtgctatagacttggggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacgacggcccctggaccaagggcttgagtggagtagggcgatccgaggtggtagtggtgcgcagtacgtcgacacgagtaagttcgagggccncgtcaccgntcggaccaaggtcgcgtaccagaatacgagtgtatagtcggacttgacgcaaggccgttaggaacggtttcgacggaaccgaaccgaaacccgggtaccctaagtttacgttaaagttttaacgtttcgggtacggaccgggtaaacgggggtacccggaaacggggggtaaaccggggggtaaaccggttaaaaaacggggaacccggttaaaagggtttaaaaaacggggtttccgggggtttaacccccgggtaaaccccccggggtttacggggggaacccccgaaaaccggggggtaaacccccgtttcgggggtaccccctaaccccggggggtttcccctaccccgtttaccgaacccgggtacccccgtaaccccggaaccccggaaaccgggggtaccccctaaccggttccccgggttccccgttttcccccccgtcgggggaaccccccgtccccgtttccggaccccgttaccccgggaacggtaacccgaccccgttacccccgggttaccgggaacggaaccgaaccccgttaaccggaccgggccccggggtccccggttcgggggtccccg

SEQ ID NO: 399657 - DNA, 504 bp, Homo sapiens
  misc_feature: GZ8MTXP01E1EM1.19.86.H09.1.454.CMB.2.raw
  modified_base (163)..(163): a, c, t, g, unknown or other
  modified_base (260)..(260): a, c, t, g, unknown or other
  modified_base (497)..(497): a, c, t, g, unknown or other
  modified_base (499)..(504): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggccccaaatcgtcatctataatgacgctgagcggtccttaagggtccctgaccgattcnctggcgagaggtctggcgctcagcttccctggccatcagagggctccagtctgaagatgaggctgattattactgtgcaaatctggggatagacaagtggtgtaaacgggtccgggttttcgggcgggagggacccaagctgaccgtctaagtcacggcccaaaggcctgccccctcggtcactctcgttccccaccctcctccacgagagtactgagcggctggcaaggcgcaagngnnnnnn

SEQ ID NO: 399658 - DNA, 725 bp, Homo sapiens
  misc_feature: GZ8MTXP01C1ZNC.19.86.H09.1.454.CMB.2.raw
  modified_base (180)..(180): a, c, t, g, unknown or other
  modified_base (355)..(355): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattancatatactctgggtgcgacaggcccctggacaagggcttgagtggatagggcgatccgaggtggtagtggtgcgcatacgtcgcacagtaagttcgagggccgcgtcaccagtcggaccaaggtcgcgtaccagaatacagtgtatagtggacttgagtcagcctggacggttcnggaccgacgaaccgggcctaagttggttaatttagttggtcggacggagggacgaaggggtacggggaacttaaaagggctaaagttaaaaggtcgggtttacccggaccccggttagggggacccgaacggggtaaccccttacggggtacccctaaccgggggttccctcccgttaccgaccgaccccttaccccgaacccggaaccgggtacccctaacggttccccgggttaccccgttccccccgttcggggccccgtccccgttcgtccccgttaccggaacgggtaccgacccgttaccccgttacccgggaaggaccgccgaacccggtaccgggccccgggtccccggttcggggtccccg

SEQ ID NO: 399659 - DNA, 833 bp, Homo sapiens
  misc_feature: GZ8MTXP01AWUEK.19.86.H09.1.454.CMB.2.raw
  modified_base (122)..(122): a, c, t, g, unknown or other
  modified_base (134)..(134): a, c, t, g, unknown or other
  modified_base (180)..(180): a, c, t, g, unknown or other
  modified_base (195)..(195): a, c, t, g, unknown or other
  modified_base (254)..(254): a, c, t, g, unknown or other
  modified_base (279)..(279): a, c, t, g, unknown or other
  modified_base (799)..(799): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggngcctggggcctnagtgaaggtctcctgcgaggcttttggatacaccttcagtcattancatatactctgggtncgacaggcccctggacaagggcttgagtggataggggcgatccaggtgtagtggtgcgnatacgtcgcacagaagtcagggccncgtcaccagtggacccgtaaggtcgaccggtaccaacggaaataccgagtaggtaatacgttacgggtaacctttggaacgccaaggggtccctaggggtaacgggttctgggaaacccgaccgttaaacccggggacccaagtttagggtaattttaaaggtttccggggtagggtaacgggaacggggtaccgggtaaccggggggtaaaccggggtaaacggtaaaacgggtaacgtaaaacggttaaaacgggttccggggtttaccccgggtaaccccgggttaccgggggtaaccccggtaaacccggggttaaaccccggttacggggttaaccccgtaacccggggtttcccgttacccgtaaccgaacccggttaccccgttaaccccgaaacccggtaacccgggacccctacggttccccggggttacccctttcccccgggtcggtaacccggtccccgttcggtacccgttaccggaacggaccgccgttacccgacggaacgtacnccgacggaccggttccggtcccgttcgggtaacc

SEQ ID NO: 399660 - DNA, 724 bp, Homo sapiens
  misc_feature: GZ8MTXP01D5UHG.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatcgaggtggtagtggtggcgcatacgtcgcacagtaagttcgagggccgcgtcaccagtcggccaaggtcgcgtccaacgaatacagtgtatatggacttgagcagccgtgacggtctaggaccgaccgaaccgggcctaagttggtttaactttagtttggtacgggacggaaggggacgaagggggaccgggggtacgtaaaagggctaaagttaaaacgggttacgggtttacccgggaacccccggttgggggaccccgtaacgggggtaaaccccttggggtaccctaacccggggttcccttacccgttaccgaccgtccccgtaccccgaacccggtaaacggggaccccctacgttccccgggttccctttccccccggtcgggccccgtccccgttcggcccgttcccgaacgggtccgacccgttacccgaccggaagaaccgcccgaacggccggccgggtaaccccgttgggtcccg

SEQ ID NO: 399661 - DNA, 565 bp, Homo sapiens
  misc_feature: GZ8MTXP01A51LB.19.86.H09.1.454.CMB.2.raw
  modified_base (293)..(293): a, c, t, g, unknown or other
  modified_base (334)..(334): a, c, t, g, unknown or other
  modified_base (339)..(339): a, c, t, g, unknown or other
  modified_base (371)..(371): a, c, t, g, unknown or other
  modified_base (532)..(533): a, c, t, g, unknown or other
  modified_base (535)..(538): a, c, t, g, unknown or other
  modified_base (540)..(565): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcgagggacggggactaaaggctaagtaaaggtggttaccgaccccgtgggggcccaggggaaccctggtccaccgtctccncacgccctccaccaacgggccccagtccgtccttcccccgnggccncccctgcctccgacggtcgccaccctcggaancgccaacgacgcccccgaccccgtgggcctacggccctagggtaccaacgggacccttaacccgtttacccccgaacgggtaacgtaacgggttaccgttagggaacggggtccggggcggttacggggaacggaaacggggccggaacctaacggtaagnncnnnngnnnnnnnnnnnnnnnnnnnnnnnnnn

SEQ ID NO: 399662 - DNA, 676 bp, Homo sapiens
  misc_feature: GZ8MTXP01CGNQ8.19.86.H09.1.454.CMB.2.raw
  modified_base (258)..(258): a, c, t, g, unknown or other
  modified_base (292)..(292): a, c, t, g, unknown or other
tcagtactctcgtgcacgaccggtgctcgatttagtgctatagacttgggtttgggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacacggcccctggacaagggcttgagtggagtagggcggatccgagggtggtagtggnggcgctatacgtcgcacagtaagttcgagggccncgtcacagtcggccaaggtcgacgtccaacgtaataacagtgtatagtggacttgagcagcctggacggtctacggacgacgaacggtactaagtcgttattagtgtggacggagggacgaggggacgggaagtaacgacgtaaagttaacggtacggtaccgacccggtcggggacccgaccgggtaacccgtcggtacccgtaccggtccgtacccgtacacccgtccccgtacccgaaccggaaccggtcccctacgttccccggttccccgttcccccggcgggtccccgtcccggttcgtcccgaccggacggccgacccgttacccgttacggaacgcgaaccgacgaccgggttcccggtcccgggttcgggtcccg

SEQ ID NO: 399663 - DNA, 500 bp, Homo sapiens
  misc_feature: GZ8MTXP01CBZBV.19.86.H09.1.454.CMB.2.raw
  modified_base (207)..(207): a, c, t, g, unknown or other
  modified_base (346)..(346): a, c, t, g, unknown or other
  modified_base (363)..(363): a, c, t, g, unknown or other
  modified_base (370)..(370): a, c, t, g, unknown or other
  modified_base (374)..(374): a, c, t, g, unknown or other
  modified_base (466)..(466): a, c, t, g, unknown or other
  modified_base (471)..(477): a, c, t, g, unknown or other
  modified_base (479)..(500): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccaacgaatacagtgtatatggacttgagcagcctgaggtctgacgacacggctatgtattattgngcgaggcgaggggacgggataaaggctaagtaaaggtcggttaccgacccgtggggacccgaacgggacctcggtaccaccgtctcctcgacgccctaccaccgaacgggccctacgtccggttccctccccgtgcccnccctgcctccgaggacnccacccngganacgcagcggccccgcgtggctcgccgttaagactggccttacccgtcgacgagtacgtacgaggcggtgggctagggaccaagggtcaacgngtacnnnnnnngnnnnnnnnnnnnnnnnnnnnnn

SEQ ID NO: 399664 - DNA, 675 bp, Homo sapiens
  misc_feature: GZ8MTXP01B1DMZ.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacgagaagttcagggccgcgtcacatcggaccaaggtcgcgtccacgaatacagtgtatatggacttgagcagcctggacggtctgaccgacgaacggcctaagtgtattagttgtgcggagggacgagggacggggactaaaggcgaagtaaaggttcggttaccgaaccccggtcggggaccgaacgggtaaccccgtcgggtacccgaccggggttccttcccgttaccgaaccgtccccgtacccgaaccccggaacgggtaccccctacgttccccgggttccccgtttccccccggttgggccccgtccccgttacggcccgttaccccgacggggaaccgccccgttacccgttcccggaacgaccggccgaaccgtcggcccgggtcccgttcggggtcccg

SEQ ID NO: 399665 - DNA, 486 bp, Homo sapiens
  misc_feature: GZ8MTXP02JXL8X.19.86.H09.1.454.CMB.2.raw
  modified_base (477)..(486): a, c, t, g, unknown or other
tcagtactctcgtgcacgaccggtgctcgatttagtgctatagacttgggtttgggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggcacccaaactcgtcatctataatgacgctgagcggtccttaagggtccctgaccgattctctggcgagaggtctggcgcctcagcttccctggccatcagagggctcagtctgaagatgaggctgattattactgtgcaatctgggatgcagtgtgaacggtccggtttcggcggagggaccaagctgaccgtctaagtcagcccaaggctcgcccctcggtcactctgttcccaccctcctccacgagacgtactgagcgggctggcaggcgcatagnnnnnnnnnn

SEQ ID NO: 399666 - DNA, 512 bp, Homo sapiens
  misc_feature: GZ8MTXP02HXJML.19.86.H09.1.454.CMB.2.raw
  modified_base (469)..(469): a, c, t, g, unknown or other
  modified_base (500)..(500): a, c, t, g, unknown or other
  modified_base (502)..(512): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggccctaggaccgattctctggcgagaggtctggcgcctcagcttccctggccatcagagggctccagtctgaagatgaggctgattatactgtgcaatctggggatgacagtgtgaacggtccggttttacgggcggaggggacccaaagctggaccgtctaagtcagcccaaggctcgccccctcggtcactctcgtttccccgccctcctccacgagagttacgngcggcggcgtcggacgaggcgacagtacgcncnnnnnnnnnnn

SEQ ID NO: 399667 - DNA, 546 bp, Homo sapiens
  misc_feature: GZ8MTXP02IQHHU.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgagtctgacgacacggcatgtattatgtgcgaggcaggacggggctaaaggcagtaaagtggttcgacccgtggggccagggaccctggcaccgtctcctcacgcctccaccaacgggccccagtccggtccttcccccgtcggcccgcccgtcgcctcccgacggacgccaccgtccgaagacgcacgacgccggcccgtcgggccg

SEQ ID NO: 399668 - DNA, 488 bp, Homo sapiens
  misc_feature: GZ8MTXP02G470L.19.86.H09.1.454.CMB.2.raw
  modified_base (349)..(349): a, c, t, g, unknown or other
  modified_base (478)..(488): a, c, t, g, unknown or other
tcagtactctcgtgcacgaccggtgctcgatttagtgctatagacttgggtttggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacggtccgtttcggcggagggacccaagctgaccgtctaagtcagcccaaggctgccccctggtcactctcgttcccaccctctccacgagacgtactgagcgggctggcaaggcgcaagtgnnnnnnnnnnn

SEQ ID NO: 399669 - DNA, 533 bp, Homo sapiens
  misc_feature: GZ8MTXP02HOUIJ.19.86.H09.1.454.CMB.2.raw
  modified_base (261)..(261): a, c, t, g, unknown or other
  modified_base (522)..(533): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtacccaggaacggcccccaaacctacgtcatctataatgacgctgagcggtccttaaggtccctgacgattntctggcgagaggtctggcgcctcagcttccctggccatcagagggctccagtctgaagatgaggctgattattactgtgcaatctgggatgacagtgtgaacggtccggttttcggcggagggtacccgaaagcgtgaccgtaccctaagtcgacgaccccgaaggacctcgccccctccggtacaccgtcctcgtttcccccaccccttcctcccacgacgacgtacgtgaggcgggcgtcggcgaaggcgccagtagcnnnnnnnnnnnn

SEQ ID NO: 399670 - DNA, 490 bp, Homo sapiens
  misc_feature: GZ8MTXP02JWZD4.19.86.H09.1.454.CMB.2.raw
  modified_base (353)..(353): a, c, t, g, unknown or other
  modified_base (481)..(490): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattatactgtgcaatctggggatgacngtgtggaacggtccggtttggcggagggaccaagctgaccgtctagtcagcccaaggctgccccctcggtcactctcgttcccgccctcctccacgagacgtactgagcgggctggcaggcgcatagnnnnnnnnnn

SEQ ID NO: 399671 - DNA, 566 bp, Homo sapiens
  misc_feature: GZ8MTXP02GDC3X.19.86.H09.1.454.CMB.2.raw
  modified_base (256)..(256): a, c, t, g, unknown or other
  modified_base (367)..(367): a, c, t, g, unknown or other
  modified_base (412)..(412): a, c, t, g, unknown or other
tcagtactctcgtgcacgaccggtgctcgatttagtgctatagacttgggtttgggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgacggtggtagtggtggcgcatacgtcgcacagaagtttcacgggccgcgtcaccatcggccagggtcncgtccacgtaatacagtgtatagtggacttgagcagcctgagtcngacgacacggccagtgtattagttgtgcgaggcgaagggacggggctaaaagggctaagtaaacggtcggttaccgaaccccggtggggaccctaaggggtacccctgggtaaccacccggttctaccgtacgacgtcccgtaccgtaacccgg

SEQ ID NO: 399672 - DNA, 496 bp, Homo sapiens
  misc_feature: GZ8MTXP02HYP5X.19.86.H09.1.454.CMB.2.raw
  modified_base (351)..(351): a, c, t, g, unknown or other
  modified_base (452)..(452): a, c, t, g, unknown or other
  modified_base (485)..(496): a, c, t, g, unknown or other
tcagtactctcgtgcacgaccggtgctcgatttagtgctatagacttgggtttggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacggtccggttttcggcggtagggacccaagctgaccgtcctaagtcagcccaaggctgcccctcggtcactctcgttcccgccctcctccacgngacgtactgacgcggctggcaaggcgcagtagnnnnnnnnnnnn

SEQ ID NO: 399673 - DNA, 485 bp, Homo sapiens
  misc_feature: GZ8MTXP02F6DNU.19.86.H09.1.454.CMB.2.raw
  modified_base (350)..(350): a, c, t, g, unknown or other
  modified_base (478)..(485): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggccctgaccgattctctggcgagaggtctggcgcctcagcttccctggccatcagagggctccagtctgaagatgaggctgattattactgtgcaatctgggatgacngtgtgaacggtccggttttggcggagggaccaagctgaccgtctaagtcagcccaaggctgccccctggtcactctcgttcccgccctcctccaccgagagtactgagcgggctggcaggcgcatagnnnnnnnn

SEQ ID NO: 399674 - DNA, 492 bp, Homo sapiens
  misc_feature: GZ8MTXP02HMRP2.19.86.H09.1.454.CMB.2.raw
  modified_base (353)..(353): a, c, t, g, unknown or other
  modified_base (481)..(481): a, c, t, g, unknown or other
  modified_base (484)..(492): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtcccctgacccgattctctggcgagaggtctggcgcctcagcttccctggccatcagagggctccagtctgaagatgaggctgattatactgtgcaatctgggatgacngtgtgaacggtccggttttcggcggagggaccaagctgaccgtctaagtcagcgcaaggctcgcccctcggtcactctcgttcccaccctcctccacgagacgtactgagcggctcggcaaggcgcanagnnnnnnnnn

SEQ ID NO: 399675 - DNA, 559 bp, Homo sapiens
  misc_feature: GZ8MTXP02G1XV8.19.86.H09.1.454.CMB.2.raw
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgaggtctgacgacacggccntgtattatgtgcgaggcaggacggggactaaaggcaagtaaagtggttccgaccccgtggggacccaggggaaccctggtaccgaccggtctccgtcacggcctcccaccaacgggcccacgtccggtccttcccccgtcggccgcccctcgcctccgacggcgccaccgtccgaagacgcacacgccgcccgtcggccg

SEQ ID NO: 399676 - DNA, 562 bp, Homo sapiens
  misc_feature: GZ8MTXP02J3E2B.19.86.H09.1.454.CMB.2.raw
  modified_base (195)..(195): a, c, t, g, unknown or other
  modified_base (361)..(361): a, c, t, g, unknown or other
  modified_base (501)..(501): a, c, t, g, unknown or other
  modified_base (534)..(534): a, c, t, g, unknown or other
  modified_base (557)..(557): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggcangtattatgtgcgaggcaggacggggctaaaggcaataaagtgggttcgaccccgtggggacccgagggaacccgtggtccaccggtctccctcacggccctccacccgaaacggggccccagtccgggtccttcccccgnggcccgccctcggcctcccgaggcgcctaaccnccgaagacgcacagccggcccgnggccg

SEQ ID NO: 399677 - DNA, 561 bp, Homo sapiens
  misc_feature: GZ8MTXP02FVG2T.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtattggtggcgcatacgtcgcacagaagtttcagggccgcgtcaccatggccaaggtcgcgtccacgaatacagtgtatagtggacttgagcagcctgaggtctgacgacacggccatgtattattgtgcgaggcagggacggggctaaaggcagtaaagtggtcgacccgtggggccgacgggaacctggtaccaccgtctcctcacgcctcccgaccgaacgggcccacgtccggtcccttcccccgtcggccgcccctgcctccgacggacgccaccctccgaacgacgaccacgacgccggcccgtgggccg

SEQ ID NO: 399678 - DNA, 581 bp, Homo sapiens
  misc_feature: GZ8MTXP02JESCJ.19.86.H09.1.454.CMB.2.raw
  modified_base (162)..(162): a, c, t, g, unknown or other
  modified_base (253)..(253): a, c, t, g, unknown or other
  modified_base (297)..(297): a, c, t, g, unknown or other
  modified_base (569)..(572): a, c, t, g, unknown or other
  modified_base (574)..(581): a, c, t, g, unknown or other
tcagtactctcgtgcacgaccggtgctcgatttagtgctatagacttgggtttgggggccgttcctgggcccagtctgtgctgactcaggcaccctcagcgtctgggaccccgggcagacggtcaccatcgcttgttctgcaagcagctcgaacatcgggancagtggtgtgatgtggtatcagaaacgtccaggaccgccccaaatcgtcatctataatgacgctgagcggtacttagggtccctgaccgtnttctcgtggcgagaggtctggccgcctcgacgcctttccccggngacctagtcgaggcggtcctacgagtcgagaagagtggagtcttagtatttacgtacgtgacgactagtcgtaggtatagacgtggttcggtacgggtacggtttccgggttaggacggacgacgacgtcgtacggtccgtcggcggaccgacgaccgacgtcccgtcccgccccgtcgtacctccgttccgttcccgtacccctacccgtaccgtaccgacgacggtacgtacggtcggacggtcggtacgcggacgacggcacgagcgcnnnngnnnnnnnn

SEQ ID NO: 399679 - DNA, 491 bp, Homo sapiens
  misc_feature: GZ8MTXP02HTPCO.19.86.H09.1.454.CMB.2.raw
  modified_base (351)..(351): a, c, t, g, unknown or other
  modified_base (480)..(480): a, c, t, g, unknown or other
  modified_base (483)..(491): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacggtccgttttgggcggagggacccaaagctgacgtcctaagtcagcccaaggctgccccctcggtcactctgtttcccgccctcctccacgagagtactgagcgggctggcaaggcgacanagnnnnnnnnn

SEQ ID NO: 399680 - DNA, 516 bp, Homo sapiens
  misc_feature: GZ8MTXP02GYQ4Y.19.86.H09.1.454.CMB.2.raw
  modified_base (350)..(350): a, c, t, g, unknown or other
  modified_base (505)..(516): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacngtgtgaaacgggttccggtttcgggcggtagggacccaaagcctagacccgtacctaagtcacgcccaaggctcgccccctcggtccactctcgttccccgccctcctccacgacgacgtactcgaggccgggctggacaagggcgacaagtgcnnnnnnnnnnnn

SEQ ID NO: 399681 - DNA, 426 bp, Homo sapiens
  misc_feature: GZ8MTXP02F7OGF.19.86.H09.1.454.CMB.2.raw
  modified_base (420)..(426): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggccccatcggtcttccccctggccgccctgcctccaggagcacctccgagagcacagcccgccctgggctgcctggtcaggactacttcccacgagagtactgagcgggctggcaaggcgcatagnnnnnnn

SEQ ID NO: 399682 - DNA, 539 bp, Homo sapiens
  misc_feature: GZ8MTXP02IZX15.19.86.H09.1.454.CMB.2.raw
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggcccaaggtcgcgtccacgaatacagtgtatatggacttgagcagcctgaggtctgacgacacggcntgtattattgtgcgaggcagggacggggactaaaggcagtaaagtggttccgacccgtggggccagggacctgggtcaccgtctcctcagcctccaccgacgggcccatccggtcctccccgtggccgccctgcctccaggacgccacctccgaagacgcacgagccggccctggggcc

SEQ ID NO: 399683 - DNA, 537 bp, Homo sapiens
  misc_feature: GZ8MTXP02GAHBG.19.86.H09.1.454.CMB.2.raw
  modified_base (478)..(478): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctggttgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgaggtctgacgacacggcatgtattattgtgcgaggcagggacgggctaaaggcaagtaaagtggtcgaccctggggccagggaccctggtccaccgtctcctcacgcctccacgaagggccaagtccggtctccccgnggccgcccgtgccgtccacggcgcaccgtccgaagacgcacgacgccggccgtgggtcc

SEQ ID NO: 399684 - DNA, 499 bp, Homo sapiens
  misc_feature: GZ8MTXP02JRZDA.19.86.H09.1.454.CMB.2.raw
  modified_base (349)..(349): a, c, t, g, unknown or other
  modified_base (487)..(487): a, c, t, g, unknown or other
  modified_base (489)..(499): a, c, t, g, unknown or other
tcagtactctcgtgcacgaccggtgctcgatttagtgctatagacttgggtttggggccgttcctgggcccagtctgtgctgactcaggcaccctcagcgtctgggaccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgagatgaggctgattatactgtgcaatctggggatgacngtgtgaacggtccggtttggcggagggaccaagctgaccgtctaagtcgagcccaaggctcgcccctcggtcactctcgttcccaccctcctccacgagacgtacgtgacggcgggctcgggacaggcggcagtacgncnnnnnnnnnnn

SEQ ID NO: 399685 - DNA, 544 bp, Homo sapiens
  misc_feature: GZ8MTXP02GJBX1.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaagaagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggtcgaccctggggccagggaaccctggtcaccgtctcctcagcctccaccagggcccagtccggtccttcccccgtggccgcccctgcctccgacggacgccaccctccgaacgacgcacgacgccggcccgtcgggccg

SEQ ID NO: 399686 - DNA, 551 bp, Homo sapiens
  misc_feature: GZ8MTXP02JVSV3.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggcatgtattattgtgcgaggcgaggacggggctaaaggcagtaaagtggttcgacccgtggggccagggaacctggtcaccgtctcctcacgcctccaccgaacgggcccatccggtcctcccccgtggcccgcccctgcctccgacggacgccacccgtccgaagacgccgacacggccggcccgtgggcccg

SEQ ID NO: 399687 - DNA, 495 bp, Homo sapiens
  misc_feature: GZ8MTXP02GUQ7M.19.86.H09.1.454.CMB.2.raw
  modified_base (349)..(349): a, c, t, g, unknown or other
  modified_base (483)..(483): a, c, t, g, unknown or other
  modified_base (486)..(495): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtatgatgtggtatcagaaagtcccaggaaccggccccaaatcgtcatctataatgacgctgagcggtccttaagggtccctgaccgattctctggcgagaggtctggcgcctcagcttccctggccatcagagggctccagtctgaagatgaggctgattatactgtgcatctggatgacngtgtgaacgggttccggtttcggcgggtagggaccaagctgaccgtctaagtcagcccaagctcgcccctcggtcacgttctcgttcccaccctcctaccacgagacgtactgacgcgggctggcaggcgacanagnnnnnnnnnn

SEQ ID NO: 399688 - DNA, 564 bp, Homo sapiens
  misc_feature: GZ8MTXP02JRZY2.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccagaatacagtgtatatggacttgagcagcctgagtctgacgacacggccntgtattatgtgcgaggcaggacggggactaaaggcaataaagtggttcgacccgtggggccagggaaccctggtccaccgtctcctcacgccctaccaccgaaacgggccccagtccgggtccttcccccgtggcccgccccgttcgcccgtccgacggacgcccacccgtccgaacgacgcgacgacgccggcccctggggcccg

SEQ ID NO: 399689 - DNA, 525 bp, Homo sapiens
  misc_feature: GZ8MTXP02IE7C5.19.86.H09.1.454.CMB.2.raw
  modified_base (256)..(256): a, c, t, g, unknown or other
  modified_base (260)..(260): a, c, t, g, unknown or other
  modified_base (291)..(291): a, c, t, g, unknown or other
  modified_base (318)..(318): a, c, t, g, unknown or other
  modified_base (412)..(412): a, c, t, g, unknown or other
  modified_base (514)..(516): a, c, t, g, unknown or other
  modified_base (518)..(525): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaaccggcccccaaatcgtcatctataatgacgctgagcggtcttagggtccctgaccgnttcnctggcgagaggtctggcgcctcagcttcccnggccatcagagggctccagtctgaagntgaggctgattattactgtgacaatctggatgactgtgtagacggttccgtttcgggcggaggacccaagtcagtaccgtctaaagcgagcganaacggctcgccccgtggtccacgtcttccgttccccgccctccgtacccacgtacgacgtaccgtggcggcgggctacgggccgaagggcaccgaatacgcnnngnnnnnnnn

SEQ ID NO: 399690 - DNA, 505 bp, Homo sapiens
  misc_feature: GZ8MTXP02IMLC4.19.86.H09.1.454.CMB.2.raw
  modified_base (353)..(353): a, c, t, g, unknown or other
  modified_base (394)..(394): a, c, t, g, unknown or other
  modified_base (493)..(493): a, c, t, g, unknown or other
  modified_base (497)..(505): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaccggccccaaatcgtcatctataatgacgctgagcggtccttaagggtccctgaccgattctctggcgagaggtctggcgcctcagcttcccctggccatcagagggctccagtctgaagatgaggctgattattactgtgcaatctgggatgacnggtgtgaaacgggtccgtttcgggcgggagggacccaagcngaccgtcctagtcagcccaaggctagccccctggtccactctcgttcccccgccctcctcccaccgagacgtactggacgcgggcgtggcaaggcgcanacgnnnnnnnnn

SEQ ID NO: 399691 - DNA, 513 bp, Homo sapiens
  misc_feature: GZ8MTXP02FTP9A.19.86.H09.1.454.CMB.2.raw
  modified_base (432)..(432): a, c, t, g, unknown or other
  modified_base (466)..(466): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtggcgcatacgtcgcacagaagtttcagggccgcgtcaccatggccaaggtcgcgtccacgaatacagtgtatatggacttgagcagcctgaggtctgacacacggccatgtattattgtgcgagcaggacggggctaaaggcataaagtggtcgaccctggggcaggacctggtcacgtcnctcagctccacaaggccatcggtctcccctggcncctgctccacggacgcacctccgaagcgcacgagcggcccgtgggcg

SEQ ID NO: 399692 - DNA, 550 bp, Homo sapiens
  misc_feature: GZ8MTXP02GGHX7.19.86.H09.1.454.CMB.2.raw
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattagttgtgcgagggcagggacggggctaaaaggcaagtaaagtggtcgaccccgtggggccagggaccctggtccaccgtctcctcagcctcccaccaacgggcccactcggtcctcccccgtggccgccctgcctccacggacgccaccctccgaacgacgccacacgccggcccgtcggggcc

SEQ ID NO: 399693 - DNA, 505 bp, Homo sapiens
  misc_feature: GZ8MTXP02IR92S.19.86.H09.1.454.CMB.2.raw
  modified_base (351)..(351): a, c, t, g, unknown or other
  modified_base (495)..(505): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacggtccggttttcggcggagggaccaagctgaccgtctagtcagcccaaggctccgcccctcggtcacctctcgttcccacccctcctcccacgacgacgtactcggacgcgggactcggacgacggcgcagtacgnnnnnnnnnnn

SEQ ID NO: 399694 - DNA, 496 bp, Homo sapiens
  misc_feature: GZ8MTXP02GEM8M.19.86.H09.1.454.CMB.2.raw
  modified_base (352)..(352): a, c, t, g, unknown or other
  modified_base (486)..(496): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacngtgtgaacggttccgtttcgggcggagggacaagctgaccgtctaagtcagcccaaggctcgccccctggtcactctcgttcccgccctcctccacgagacgtacctgacgcgggctggcgaaggcgacatagnnnnnnnnnnn

SEQ ID NO: 399695 - DNA, 531 bp, Homo sapiens
  misc_feature: GZ8MTXP02F71PQ.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgagtctgacgacacggccatgtattattgtgcgaggcaggacggggctaaaggcataaagtggttcgacccctggggccagggaaccctggtcaccgtctcctcagcctccaccaagggcccatcggtctccccctggccgccctgctccacggacgccacctccgaagacgcacagccggccctgggcc

SEQ ID NO: 399696 - DNA, 515 bp, Homo sapiens
  misc_feature: GZ8MTXP02H50F3.19.86.H09.1.454.CMB.2.raw
  modified_base (259)..(259): a, c, t, g, unknown or other
  modified_base (353)..(353): a, c, t, g, unknown or other
  modified_base (414)..(414): a, c, t, g, unknown or other
  modified_base (502)..(502): a, c, t, g, unknown or other
  modified_base (504)..(515): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattcnctggcgagaggtctggcgcctcagcttccctggccatcagagggctccagtctgaagatgaggctgattatactgtcgcaatctggggatgacngtgtgaacgggttccggtttcgggcggtagggaccaagctgaccgtcaagtcagccaagcncgccccctgtcactcctcgttccccgccctaccctccacgagacgtacgtcgacggccgggcgtcgggaccaagggccgacgatacgngnnnnnnnnnnnn

SEQ ID NO: 399697 - DNA, 515 bp, Homo sapiens
  misc_feature: GZ8MTXP02HUJ4U.19.86.H09.1.454.CMB.2.raw
  modified_base (260)..(260): a, c, t, g, unknown or other
  modified_base (352)..(352): a, c, t, g, unknown or other
  modified_base (507)..(515): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattcnctggcgagaggtctggcgcctcagcttccctggccatcagagggctccagtctgaagatgaggctgattattactgtgcaatctgggatgangtgtagtaacggttccggttttcgggcgggagggtaccgaaagctgaccgtctaagtcagcccgaaggcctcgccccctgtccacttctcgttccccgccccttcctcccacgacgacgtacgtggacgcgggctcggacgaacggcgcatagcnnnnnnnnn

SEQ ID NO: 399698 - DNA, 497 bp, Homo sapiens
  misc_feature: GZ8MTXP02HRDJ7.19.86.H09.1.454.CMB.2.raw
  modified_base (163)..(163): a, c, t, g, unknown or other
  modified_base (352)..(352): a, c, t, g, unknown or other
  modified_base (474)..(474): a, c, t, g, unknown or other
  modified_base (488)..(497): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcggtccttaagggtccctgaccgtattctctcccggcgagaggtctggcgcctcagcttcctggccatcagagggctccagtctgaagatgagctgattatactgtgcaatctggatgacngtgtgaacggttccggttttcgcgggaagggaccaaagctgaccgtcctaagtcacgcccgaagctcgccccctcggtccactctcgtttcccaccctcctccacgagagtactgagcggcnggcaagcgcatagnnnnnnnnnn

SEQ ID NO: 399699 - DNA, 495 bp, Homo sapiens
  misc_feature: GZ8MTXP02JSV4Z.19.86.H09.1.454.CMB.2.raw
  modified_base (317)..(317): a, c, t, g, unknown or other
  modified_base (353)..(353): a, c, t, g, unknown or other
  modified_base (483)..(495): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgattctctggcgagaggtctggcgcctcagcttccctggccatcagagggctccagtctgaagntgaggctgattatactgtcgcaatcgtgggatgacngtgtggaacggttcggtttcggcggtagggaccaagctgaccgtctaagtcagcccagctcgcccctggtcactctcgttcccgccctctccacgagacgtactgagcggctggcgaggcgacagtacgnnnnnnnnnnnnn

SEQ ID NO: 399700 - DNA, 560 bp, Homo sapiens
  misc_feature: GZ8MTXP02IULYN.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgatggatagggcggatccgaggtggtagtggtggcgcatacgtcgcacagaagtttcagggccgcgtcaccatggccaaggtcgcgtccacgaatacagtgtaatatggacttgagcagcctgaggtctgacgacacggccatgtattattgtgcgaggcaggacggggctaaaggcaagtaaagtggttccgaccccgtggggccagggaaccctggtcaccgtctcctcacgcctccaccgaaacgggccccagtccggtccttcccccgtggcccgccctcggcctcccgacggacgaccaccctccgaagacgaccacagccggtcccgtcgggccg

SEQ ID NO: 399701 - DNA, 537 bp, Homo sapiens
  misc_feature: GZ8MTXP02JWXVT.19.86.H09.1.454.CMB.2.raw
tcagtactctcgtgcacgaccggtgctcgatttagtgctatagacttgggtttgggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggcttttggatacaccttcagtcattatcatatactctgggtgcgacaggcccctggacaagggctgagtggatagggcggatccacggtggtagtggtggcgcatacgtcgcacagaagtttcagggccgcgtcaccatggcaggtcgcgtccacgaatacagtgtatatggacttgagcagcctgagtctgacgacacggccatgtattagtgtgcggaggcgagggacggggacgtaaaaggcaaagtaaaaggtggttaccgaccccgtggggccgacgggaaccctggccgaccggtctcctcacggcctacgaacccg

SEQ ID NO: 399702 - DNA, 555 bp, Homo sapiens
  misc_feature: GZ8MTXP02GRCDI.19.86.H09.1.454.CMB.2.raw
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgagtctgacgacacggcntgtattattgtgcgaggcgaggacggggctaaaggcagtaaagtggttcgacccgtggggccagggaccctggtcaccgtctcctcacgccctccaccgaacgggcccacgtccggtccttcccccgtcggtccgcccctcgccctccacggacgccaccgtccgaacgacgcacgacggccggcccgtgggcccg

SEQ ID NO: 399703 - DNA, 514 bp, Homo sapiens
  misc_feature: GZ8MTXP02J1PBT.19.86.H09.1.454.CMB.2.raw
  modified_base (288)..(288): a, c, t, g, unknown or other
  modified_base (466)..(466): a, c, t, g, unknown or other
  modified_base (502)..(502): a, c, t, g, unknown or other
  modified_base (504)..(514): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggccctgaccgattctctggcgagaggtctggcgcctcagcttcccnggccatcagagggctccagtctgaagatgaggctgattatactgtgcaatctgggatgacaggtgtgaacggttcggtttacggcggtagggacccaagctgaccgtctaagtcagcccaaggctcgccccctcggtcactctcgttccccaccctccctccacgacgtacgtaccgngacggcggcgtacggacgacgggccgctaatacgcncnnnnnnnnnnn

SEQ ID NO: 399704 - DNA, 532 bp, Homo sapiens
  misc_feature: GZ8MTXP02GBLFF.19.86.H09.1.454.CMB.2.raw
  modified_base (446)..(446): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggcctaaaggcataaagtggttcgacccctggggccaggggaaccctggtcacgtctcctcagcctccaccaagggcccatccggtcttccccctgccgccctgctccaggngcacctccgagacgcacacgcggccctgggctcgcctggtcaacggactacttcccacgagaagtactgacgcggctcggcaacgg

SEQ ID NO: 399705 - DNA, 535 bp, Homo sapiens
  misc_feature: GZ8MTXP02GMVM7.19.86.H09.1.454.CMB.2.raw
tcagtactctcgtgcacgaccggtgctcgatttagtgctatagacttgggtttggggaagaggaagactgacggcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtgatagggcgatccaggtggtagtggtggcgcatacgtcgcacagaagtttcagggccgcgtcaccatggccaaggtcgcgtccacgaatacagtgtatatggacttgagcagcctgagtctgacgacacggccatgtattattgtgcgagggcagggacggggctaaagggcaagtaaagtggttcgacccgtggggccagggaaccctggtcacgtctcctcagcctccaccaacgggcccatccggtctcccccgtggccgccctgcctccaggacgccacctcccgaagacgcacacgccggccctgggcc

SEQ ID NO: 399706 - DNA, 520 bp, Homo sapiens
  misc_feature: GZ8MTXP02GADOQ.19.86.H09.1.454.CMB.2.raw
  modified_base (478)..(478): a, c, t, g, unknown or other
  modified_base (482)..(482): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgaggtctgacgacacggcatgtattattgtgcgaggcagggacgggactaaaggcaataaagtggttcgacccgtggggccagggaaccctggtcaccgtctcctcacgcctccacagggccatcgtctcccctgcncctnctcacgacgcacctcgaagacgcacagccggcctgggc

SEQ ID NO: 399707 - DNA, 526 bp, Homo sapiens
  misc_feature: GZ8MTXP02G2NYQ.19.86.H09.1.454.CMB.2.raw
  modified_base (318)..(318): a, c, t, g, unknown or other
  modified_base (353)..(353): a, c, t, g, unknown or other
  modified_base (515)..(526): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctcagtctgaagntgaggctgatttatactgtgcaatctgggatgacngtgtgacgggttccggtttcgggcggtacgggaccaagcgtagaccgtctaagtccgagcccgaaggcctcgccccctcggtccaccttctcgttccccaccccttcctacccacgacgacgtactcggacgccgggctcgggacgaagggcgctagacgcnnnnnnnnnnnn

SEQ ID NO: 399708 - DNA, 573 bp, Homo sapiens
  misc_feature: GZ8MTXP02JDEGK.19.86.H09.1.454.CMB.2.raw
  modified_base (195)..(195): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgagtctgacgacacggccatgtattatgtgcgaggcaggacggggactaaaggcaataaagtggttaccgacccgtggggccagggaaccctggtccacgtctcctcacgcctaccgaccgaacgggcccacgtccggtccttcccccgtcggtcccgccccgttgcccgtcccgaacgggacgacccgacccgtcccgaaggcgaccgacgacggccggcccgtcgggcccg

SEQ ID NO: 399709 - DNA, 559 bp, Homo sapiens
  misc_feature: GZ8MTXP02IT9SU.19.86.H09.1.454.CMB.2.raw
  modified_base (345)..(345): a, c, t, g, unknown or other
  modified_base (358)..(358): a, c, t, g, unknown or other
  modified_base (369)..(369): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagtttcagggccgcgtcaccatggccaaggtcgcgtccacgaatacagtgtatatggacttgagcagcctgaggtcngacgacacggccntgtattattgngcgaggcagggacggggactaaaggcaagtaaagtggttccgacccgtggggccagggaaccctggtcaccggtctcctcacgccctaccaccgaaacggcccagtccggtcttcccccgtcggcccgcccgtcgcctccgacggcgccgaacccgtccgaacgacgccacgacgccggtcccgtggccg

SEQ ID NO: 399710 - DNA, 641 bp, Homo sapiens
  misc_feature: GZ8MTXP02JYS4O.19.86.H09.1.454.CMB.2.raw
  modified_base (163)..(163): a, c, t, g, unknown or other
  modified_base (624)..(624): a, c, t, g, unknown or other
  modified_base (626)..(626): a, c, t, g, unknown or other
  modified_base (628)..(628): a, c, t, g, unknown or other
  modified_base (631)..(631): a, c, t, g, unknown or other
  modified_base (633)..(633): a, c, t, g, unknown or other
  modified_base (635)..(636): a, c, t, g, unknown or other
  modified_base (638)..(638): a, c, t, g, unknown or other
  modified_base (640)..(641): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcggttccttaagggtccctgaccgattctctggcgagaggtctggcgcctcagcttccctggccatcagagggctccagtctgaagatgaggctgattatactgtgcaatcgtggggatgactgtgtaggtaaaccggttccggggttttcgggcggggaaggggtacccaaagtccgtacggacccgttaccttaaacggtcgacggccccgaaacgggcctccgggtccccccgttcgggtacccaccgttcccgtttccggcccccgtccccttacccccgttccccgaaccggtaacggtaaccggttaccgttacggggaaccgggccgggggtaccgttcgggggacccgtaaaacgggggccccggacctaaacgggtacggcgcngngngcncncnncncnn

SEQ ID NO: 399711 - DNA, 552 bp, Homo sapiens
  misc_feature: GZ8MTXP02FMX16.19.86.H09.1.454.CMB.2.raw
  modified_base (348)..(348): a, c, t, g, unknown or other
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgaggtcngacgacacggcntgtattattgtgcgaggcagggacggggactaaaggcagtaaagtggtacgacccgtggggccacgggacctggtccaccggtctcctcacgcctccaccgacgggcccactccggtcctcccccgtcggccgtcccgtcgcctccgacggacgccaccgtccgaagacgcacgacggccggcccgtggccg

SEQ ID NO: 399712 - DNA, 570 bp, Homo sapiens
  misc_feature: GZ8MTXP02FUG08.19.86.H09.1.454.CMB.2.raw
  modified_base (533)..(533): a, c, t, g, unknown or other
tcagtactctcgtgcacgaccggtgctcgatttagtgctatagacttgggtttgggggaagaggaagactgacggccccactcccaggtgcagctgatgcagtctggggctgaggtgaaggagcctggggcctcagtgaaggtctcctgcgaggcttttggatacaccttcagtcattatcatatactctgggtgcgacaggcccctggacaagggcttgagtggagtagggcggatccgaggtggtagtggtggcgcatacgtcgcacagaaagtttcagggccgcgtcaccatggccaaggtcgcgtccacgatacagtgtatatggacttgagcagcccctgaggtctgacgacacgggccatgtattatgtgcgagcaggacggggctaaaggcaagtaaaagtggttacgacccgtggggaccgacgggaaacccgtggtaccgtacccgtcgtccctcacgcccctaccaccgaacgggccccactccggtcccttccccctcggccgccctcgcctccgacggacnccgaccctccgacgacgacacgacgccggcctcgggg

SEQ ID NO: 399713 - DNA, 588 bp, Homo sapiens
  misc_feature: GZ8MTXP02G5831.19.86.H09.1.454.CMB.2.raw
  modified_base (195)..(195): a, c, t, g, unknown or other
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgagtctgacgacacggccntgtattattgtgcgaggcgaagggacggggacgtaaaggacgaagtaaaggtggttaccggaccccgtcgggggaccgacggggaacccgttcggtccgaccgtccttcccgtccacggccctcccgacccgaacgggcccacgtccgtccgttccccgtcggccgccccgtcgcctccgacggacgccaacccgtccgaagcgacgacacggtccggcccgtggccg

SEQ ID NO: 399714 - DNA, 543 bp, Homo sapiens
  misc_feature: GZ8MTXP02IBGN1.19.86.H09.1.454.CMB.2.raw
  modified_base (195)..(195): a, c, t, g, unknown or other
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgaggtctgacgacacggccntgtattattgtgcgagggcagggacgggcgtaaaggcaagtaaagtggttaccgaccccgtggggaccacgggaccctggtccaccggtctcctcacgcctccacacggccatccgtctcccctggccgccctcgctccgacgcgaccaccgtccgaagacgcacacgccggcccgtcgggccg

SEQ ID NO: 399715 - DNA, 522 bp, Homo sapiens
  misc_feature: GZ8MTXP02IXZ77.19.86.H09.1.454.CMB.2.raw
  modified_base (481)..(481): a, c, t, g, unknown or other
  modified_base (484)..(484): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctgacgacacggcatgtattatgtgcgagggcagggacggggctaaaggcagtaaagtggttaccgacccgtggggccagggaaccctggtcaccgtctcctcagcctccaccgaggcccatcgtctccccgtgcnccngctccacgacgcacctccgaagacgcacagcgcctggc

SEQ ID NO: 399716 - DNA, 603 bp, Homo sapiens
  misc_feature: GZ8MTXP02G6Q6H.19.86.H09.1.454.CMB.2.raw
  modified_base (304)..(304): a, c, t, g, unknown or other
  modified_base (318)..(318): a, c, t, g, unknown or other
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcncgtccacgaatacngtgtatatggacttgagcagcctgagtctgacgacacggcngtgtattattgtgcgaggcgagggacggggactaaaggcgaagtaaagtgggttaccggaccccgtcgggggaccgacggggaacccgtgggtccacccggtcctccgtcacgccctccaccgaacgggcccacgtcccggttccttccccccgttcgggcccgccccgttcgcccgttcccgaacgggaccgccaacccgtcccgaacgacgccgaccgacggcccggccccgtcggggcccg

SEQ ID NO: 399717 - DNA, 525 bp, Homo sapiens
  misc_feature: GZ8MTXP02HDJKT.19.86.H09.1.454.CMB.2.raw
  modified_base (195)..(195): a, c, t, g, unknown or other
  modified_base (481)..(481): a, c, t, g, unknown or other
  modified_base (514)..(514): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtgtagtggtggcgcatacgtcgcacagaagtttcagggccgcgtcaccatggccaaggtcgcgtccacgaatacagtgtatatggacttgagcagcctgaggtctgacgacacggcatgtattattgtgcgaggcagggacggggctaaaggcaataaagtggttccgacccgtggggccagggaaccctggtcaccgtctcctcagccctcaccaagggcccatccggtctcccctggcnccctgctccacggacgcacctcgaagacgcacngcgcccgtggc

SEQ ID NO: 399718 - DNA, 566 bp, Homo sapiens
  misc_feature: GZ8MTXP02HUQ2K.19.86.H09.1.454.CMB.2.raw
  modified_base (195)..(195): a, c, t, g, unknown or other
  modified_base (334)..(334): a, c, t, g, unknown or other
  modified_base (387)..(387): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgancagcatgagtctgacacacggccatgtattattgtgcgagcgagggacggggntaaaggcaataaagtggttacgacccgtggggaccacgggaaccgtggtcaccgtctcctcacgcctccaccaacgggcccacgtccggtcccttcccccgtcggcccgtccccgtcgccctacccgacggacgccgaacccgtcccgacgacgccgacgacggccggtcccgtcgggg

SEQ ID NO: 399719 - DNA, 531 bp, Homo sapiens
  misc_feature: GZ8MTXP02FJ1Z4.19.86.H09.1.454.CMB.2.raw
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaaggcataaaagtggtcgaccctggggccagggaaccctggtcaccgtctcctcagcctccaccaagggcccatcggtcttccccctggcgccctgcctccacggacgcacctccgaagacgcacagcggccctcgggcg

SEQ ID NO: 399720 - DNA, 502 bp, Homo sapiens
  misc_feature: GZ8MTXP02HFJKF.19.86.H09.1.454.CMB.2.raw
  modified_base (290)..(290): a, c, t, g, unknown or other
  modified_base (312)..(312): a, c, t, g, unknown or other
  modified_base (317)..(317): a, c, t, g, unknown or other
  modified_base (352)..(352): a, c, t, g, unknown or other
  modified_base (473)..(473): a, c, t, g, unknown or other
  modified_base (483)..(483): a, c, t, g, unknown or other
  modified_base (487)..(487): a, c, t, g, unknown or other
  modified_base (490)..(490): a, c, t, g, unknown or other
  modified_base (492)..(502): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttcccnggccatcagagggctccagtcngaagntgaggctgatttatactgtgcaatctgggatgacnggtgtggaacggttccggtttggcggagggaccagctgaccgtctaagtcacgcccaaggcctcgccccctcggtcactctcgttcccaccctctcccacgagacgtactgacgcgggtcngggcacggcncgangcncnnnnnnnnnnn

SEQ ID NO: 399721 - DNA, 506 bp, Homo sapiens
  misc_feature: GZ8MTXP02IPDF1.19.86.H09.1.454.CMB.2.raw
  modified_base (162)..(162): a, c, t, g, unknown or other
  modified_base (354)..(354): a, c, t, g, unknown or other
  modified_base (396)..(396): a, c, t, g, unknown or other
  modified_base (498)..(506): a, c, t, g, unknown or other
tcagtactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggancagtggtgtgatgtggtatcaagaaagtcccaggaaccggccccaaatcgtcatctataatgacgctgagcggttccttaagggtccctgaccgtattctctggcgaggaggtctggcgcctcagcttccctggccatcagagggctcagtctgaagatgaggctgattatactgtgacaatctggatgacngtgtagaacggttccggtttcgggcggagggaccaaagtcgngaccgtctaagtcagcgacaaggctcgcccctcggtccactcctcgttcccctaccctccctccaccgacgtagtactgagcggcgtcgcgaggcacatagnnnnnnnnn

SEQ ID NO: 399722 - DNA, 575 bp, Homo sapiens
  misc_feature: GZ8MTXP02ILG0C.19.86.H09.1.454.CMB.2.raw
  modified_base (320)..(320): a, c, t, g, unknown or other
  modified_base (362)..(362): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtgggtggcgcatacgtcgcacagaagtttcagggccgcgtcaccatggcccaaggtcgcgtccacgaatacngtgtatatggacttgagcagcctgagtctgacgacacggccntgtattattgtgcgagggcaggggacggggctaaagggcaataaaagtggttaccgacccgtggggaccacggggaacccgtggtccaccgtcctcctcacggccctccgaccgacgggcccacgtccggtccttcccccgcggccgccctcgccgtccgacggacgccacccgtccgaacgacgccaaacgcggcccggcccgcggggtccg

SEQ ID NO: 399723 - DNA, 421 bp, Homo sapiens
  misc_feature: GZ8MTXP02J0S8L.19.86.H09.1.454.CMB.2.raw
  modified_base (401)..(401): a, c, t, g, unknown or other
  modified_base (417)..(421): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggccccatcggtcttccccctggcgcccctgctccaggagcacctccgagagcacagccggccctgggctgcctggtcaggctacttcccagagagtactgagcgggntggcaaggcgcatagnnnnn

SEQ ID NO: 399724 - DNA, 525 bp, Homo sapiens
  misc_feature: GZ8MTXP02JECR9.19.86.H09.1.454.CMB.2.raw
  modified_base (194)..(194): a, c, t, g, unknown or other
  modified_base (282)..(282): a, c, t, g, unknown or other
tcagtactctcgtgcacgaccggtgctcgatttagtgctatagacttgggtttggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccacggtggtagtggtggcgcatacgtcgcacagaagtttcagggccncgtcaccatggccaaggtcgcgtccacgaatacagtgtatatggacttgagcagcctgaggtctgacgacacggccatgtattatgtgcgaggcaggacggggctaaaaggcataaagtggtcgaccctggggccagggaaccctggtcaccgtctcctcagcctccaccaagggcccatcggtcctccccgtggccgccctgcctccgagacgcacctctaagcgcacagccggcctgggcc

SEQ ID NO: 399725 - DNA, 519 bp, Homo sapiens
  misc_feature: GZ8MTXP02HKKRY.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagtttcagggccgcgtcaccatggccaaggtcgcgtccacgaatacagtgtatatggacttgagcagcctgaggtctgacgacacggccatgtattatgtgcgaggcaggacgggctaaaggcataaagtggttcgacccgtggggccagggaaccctggtcaccgtctctcagcctcaccaagggcccatcggtctcccctgccgccctgctccagacgccacctccgaagacgcacagccgcctgggcc

SEQ ID NO: 399726 - DNA, 510 bp, Homo sapiens
  misc_feature: GZ8MTXP02FQMNT.19.86.H09.1.454.CMB.2.raw
  modified_base (319)..(319): a, c, t, g, unknown or other
  modified_base (353)..(353): a, c, t, g, unknown or other
  modified_base (499)..(510): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgagntgaggctgattatactgtgcaatctgggatgacngtgtgaacggttccggtttcggcgggtagggaccaagctgaccgtctaagtcagcccaaggctcgcccctcggtccactctcgttcccaccctcctccacgagacgtactggacgcgggcgtcggacgaacggcgccgatacggcnnnnnnnnnnnn

SEQ ID NO: 399727 - DNA, 499 bp, Homo sapiens
  misc_feature: GZ8MTXP02JXFUM.19.86.H09.1.454.CMB.2.raw
  modified_base (351)..(351): a, c, t, g, unknown or other
  modified_base (487)..(487): a, c, t, g, unknown or other
  modified_base (490)..(499): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacgggttccggtttcggcggagggaccaagctgacccgtctaagtcagcccaaggctcgcccctcggtcactctcgttccccgccctcctccacgacgacgtactgacggcgggctggacacggcgctanagnnnnnnnnnn

SEQ ID NO: 399728 - DNA, 536 bp, Homo sapiens
  misc_feature: GZ8MTXP02FHBHL.19.86.H09.1.454.CMB.2.raw
  modified_base (348)..(348): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtcngacgacacggccatgtattattgtgcgaggcaggacggggctaaaggcataaagtggtcgaccctggggccagggaaccctggtcaccgtctcctcagcctccaccaacgggcccatcggtccttcccccgtggccgccctgcctccgacggacgcacctccgaagacgcacacgcggccctgggccg

SEQ ID NO: 399729 - DNA, 558 bp, Homo sapiens
  misc_feature: GZ8MTXP02HNVL6.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgagtctgacgacacggccntgtattattgtgcgaggcgagggacggggactaaaggcaagtaaagttggttaccgacccgtggggccagggaacctggtcaccgtctcctcacgccctccaccgaacgggcccacgtccgtccttcccccgtcggccgcccgtgcctccgacggtacgcccgacctccgaacgcgaccacgacgccggcccgtcggccg

SEQ ID NO: 399730 - DNA, 498 bp, Homo sapiens
  misc_feature: GZ8MTXP02JZZFC.19.86.H09.1.454.CMB.2.raw
  modified_base (353)..(353): a, c, t, g, unknown or other
  modified_base (450)..(450): a, c, t, g, unknown or other
  modified_base (488)..(498): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtggaacggttcggtttcggcggtagggaccaagctgaccgtctagtcacgcccaggcctcgccccctggtccactctcgtcccgccctcctccncgacgagtactgagcgggctggcaagggcacgatacgnnnnnnnnnnn

SEQ ID NO: 399731 - DNA, 498 bp, Homo sapiens
  misc_feature: GZ8MTXP02IK55F.19.86.H09.1.454.CMB.2.raw
  modified_base (487)..(498): a, c, t, g, unknown or other
tcagtactctcgtgcacgaccggtgctcgatttagtgctatagacttgggtttgggggccgttcctgggcccagtctgtgctgactcaggaaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggcctgaccgattctctggcgagaggtctggcgcctcagcttccctggccatcagagggctccagtctgaagatgaggctgattattactgtgccaatctgggatgacagtgtgaacggtccggtttcgcgggtaggaccaagctgaccgtctaagtcagcgcaaggctacgccccctcggtcaccttctcgttccccaccctcctcccacgacgacgtactgagcgggctggcaggcgcatagnnnnnnnnnnnn

SEQ ID NO: 399732 - DNA, 548 bp, Homo sapiens
  misc_feature: GZ8MTXP02FU3U9.19.86.H09.1.454.CMB.2.raw
  modified_base (335)..(335): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgancagctgaggtctgacgacacggccatgtattattgtgcgaggcagggacggggctaaaggcagtaaagtggttcgaccccgtggggccagggacctggtcaccgtctcctcacgcctccaccaacgggcccagtccggtcttcccccgtggccgccctgcctccacggacgccaccgtccgaagcggacaccgacggccggcccgtcgggccg

SEQ ID NO: 399733 - DNA, 572 bp, Homo sapiens
  misc_feature: GZ8MTXP02H578W.19.86.H09.1.454.CMB.2.raw
  modified_base (195)..(195): a, c, t, g, unknown or other
  modified_base (358)..(358): a, c, t, g, unknown or other
  modified_base (386)..(386): a, c, t, g, unknown or other
  modified_base (452)..(452): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagttcagggccgcgtcaccatggccaaggtcgcgtccacgaatacagtgtatatggacttgagcagcctgagtctgacgacacggccntgtattattgtgcggagcagggacgggngtaaaggcaagaaagtggttaccgaccccgtgggggccgacgggaccctggtccaccgtcttcccncacgccctaccaccgaacgggccccacgtcccggtccttcccccgtcggcccgcccgttcgccctccgacggacgccgacccgtccgaacgacgccgacgacggcccggccgtcgggccg

SEQ ID NO: 399734 - DNA, 602 bp, Homo sapiens
  misc_feature: GZ8MTXP02HCV3D.19.86.H09.1.454.CMB.2.raw
  modified_base (180)..(180): a, c, t, g, unknown or other
  modified_base (334)..(334): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattancatatactctgggtgcgacaggcccctggacaagggcttgagtggatagggcggatccgagggtggtagtggtggcgcatacgcgcacagaagttcagggccgcgtcaccatggccaaggtcgcgtccacgaatacagtgtatatggacttgancagcctgaggtctgacgacacggcatgtattattgtgcgaggcgagggacgggactaaaggacaagtaaaacgttggttacccgaccccgtcgggggacccgaacggggaaccccgtggtaccgaccgtccgttaccctccgacgcccctacccgaccgaacgggcccctacgtccggtccctcccccgtcggcccgcccgtcgccctaccgacggacgcccgacccgccggaacgacgccgaaccgacggccggcccgttgggcccg

SEQ ID NO: 399735 - DNA, 496 bp, Homo sapiens
  misc_feature: GZ8MTXP02I64SJ.19.86.H09.1.454.CMB.2.raw
  modified_base (354)..(354): a, c, t, g, unknown or other
  modified_base (485)..(496): a, c, t, g, unknown or other
tcagtactctcgtgcacgaccggtgctcgatttagtgctatagacttgggtttgggggccgttcctgggcccagtctgtgctgactcaggcaccctcagcgtctggggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattctctggcgagaggtatggcgcctcagcttccctggccatcagagggctccagtctgaagatgaggctgattattactgtgcaatctgggatgacngtgtggaacggtccggtttggcggagggaccaagctgaccgtctaagtcagcccaaggctcgcccctgtcactctcgttcccaccctcctaccacgagtagtactggacgcgggctggcaaggcgcagagnnnnnnnnnnnn

SEQ ID NO: 399736 - DNA, 537 bp, Homo sapiens
  misc_feature: GZ8MTXP02GSSOR.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgagtctgacgacacggcatgtattattgtgcgagcaggacgggctaaaggcataaagtggtcgaccctggggccagggaccctggtcaccgtctcctcagcctccaccaacgggcccatccggtctccccctcggccgccctgcctccgacggacgccaccctccgaagacgccgacacggccggcccgtcgggccg

SEQ ID NO: 399737 - DNA, 568 bp, Homo sapiens
  misc_feature: GZ8MTXP02HGK2L.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctgacgacacggcatgtattatgtgcgaggcagggacggggactaaaggcaagtaaagtcggttaccgaccccgtggggccgacgggaacccgtggtccaccgtcttcctcacgccctccaccgaacgggcccacgtccggtcctcccccgtcggcccgcccgttcgcctccgacggcgacccacccgccgaacgacgaccaccgagccggcccgtcgggccg

SEQ ID NO: 399738 - DNA, 664 bp, Homo sapiens
  misc_feature: GZ8MTXP02HMF9V.19.86.H09.1.454.CMB.2.raw
  modified_base (651)..(653): a, c, t, g, unknown or other
  modified_base (655)..(655): a, c, t, g, unknown or other
  modified_base (657)..(659): a, c, t, g, unknown or other
  modified_base (661)..(661): a, c, t, g, unknown or other
  modified_base (663)..(664): a, c, t, g, unknown or other
tcagtactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtccaggaaccggccccaaatcgtcatctaataatgacgctgagcggtcttaagggtccctgaccgattctcgtggcgagaggtctggcgcctcagcttccctggccatcagagggctcaagtctgaagatgaggctgatttatactgtgactaatcgtagggatgactgtgtaggtaaaccgggttccgggttttcgggacgggaacgggaacccgaaagtccgtacggtaaccccgttaccgttaaaacggtcccgaacgaccccgaaaacggggcccttacccggaccccccccgttcggggtccctaacccgttccgtttacccgggttttcccccccccgtacccccgttaccccgtaccccgtaaaccgggtaaccggtaaccggttaaccgggtacgggaccgggtccggggtacggtacgggaaccggaacgggtccgacgtaacgtacgacgcgnnngncnnncncnn

SEQ ID NO: 399739 - DNA, 573 bp, Homo sapiens
  misc_feature: GZ8MTXP02I9WOV.19.86.H09.1.454.CMB.2.raw
  modified_base (285)..(285): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagtgcggatccacgggtggtagtggtggcgcatacgtcgcacagaagtttcagggccncgtcaccatggccaaggtcgcgtccacgaatacagtgtatatggacttgagcagcccctgaggtctgacgcacggccatgtattatgtgcgaggcaggacgggacgtaaaggcaagtaaagtggttacgaccccgtggggaccgacgggacccgtggtcaccggtctccctcgacgccctaccgaccgaacgggcccagtccggtccttcccccgtcggccgccccgtcgcccttaccgacggacgccgacccgtccgacgacgaccgacgacggccggcccgtcggg

SEQ ID NO: 399740 - DNA, 488 bp, Homo sapiens
  misc_feature: GZ8MTXP02IYZBI.19.86.H09.1.454.CMB.2.raw
  modified_base (352)..(352): a, c, t, g, unknown or other
  modified_base (372)..(372): a, c, t, g, unknown or other
  modified_base (480)..(488): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttcccctggccatcagagggctccagtctgaagatgaggctgattatactgtcgcaatctggatgacngtgtgaacggtcgtttcggnggagggacaagctgcgtctaagtcagcccaaggctcgccccctcggtcactctcgttccccaccctcctccacgagataccgtgacgcgggctggcaaggcgcatagnnnnnnnnn

SEQ ID NO: 399741 - DNA, 588 bp, Homo sapiens
  misc_feature: GZ8MTXP02IMALD.19.86.H09.1.454.CMB.2.raw
  modified_base (363)..(363): a, c, t, g, unknown or other
  modified_base (527)..(527): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggagtagggcgatccgaggtggtagtggtggcgcatacgtcgcacagaagtttcagggccgcgtcaccatggaccaaggtcgcgtccacgaatacagtgtatatggacttgagcagcctgagtctgacgacgacggccntgtattattgtgcgaggcgaggggacggggactaaaaggctaagtaaaaggttcggttaccggaccccgtcgggggacccgacggggaaacccgtggtacccaccgtcctcctcacgccctccgaccaacgggcccacgtccggtcccttcccccgtcggcccncccgtgccctcgacggacgcccaccgtccggaagacgaccacgacgccggcccgtggcccg

SEQ ID NO: 399742 - DNA, 564 bp, Homo sapiens
  misc_feature: GZ8MTXP02GRARG.19.86.H09.1.454.CMB.2.raw
  modified_base (303)..(303): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagttcagggccgcgtcaccatggccaaggtccncgtccacgaatacagtgtatatggacttgagcagcctgaggtctgacgacacggcatgtattattgtgcgaggcagggacgggataaaggcaagtaaaagtggttccgaccccgtggggaccacgggaaccctaggtcaccgtctcctcacgccctaccaccgaacgggcccaagtccggtccttcccccgcggtccgcccgtcggcctccgacggacgccgaaccgtccgaacgacgcacgacggccggcccgtcggccg

SEQ ID NO: 399743 - DNA, 554 bp, Homo sapiens
  misc_feature: GZ8MTXP02IIKSC.19.86.H09.1.454.CMB.2.raw
tcagtactctcgtgcacgaccggtgctcgatttagtgctatagacttgggtttgggggaagaggaagactgacggccccactcccaggtgcatctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccagaatacagtgtatatggacttgagcagcctgaggtctgacgacacggcatgtattattgtgcgaggcagggacggggactaaaggcaagtaaagtggtccgacccgtggggccagggaccctggtccaccgtctcctcacgccctccaccgaacgggccccagtccggtcctcccccgtggccgcccgtgcctccacggtacgccaccctccggaagacgacacgacgccggcccgtcgggccg

SEQ ID NO: 399744 - DNA, 569 bp, Homo sapiens
  misc_feature: GZ8MTXP02G1N5X.19.86.H09.1.454.CMB.2.raw
tcagtactctcgtgcacgaccggtgctcgatttagtgctatagacttgggtttgggggaaggaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgagtctgacgacacggccatgtattattgtgcgagggcaggacggggactaaaggcaataaaagtggttaccggacccccgtggggaccgacggggaaacccgtggtaccacccgtcgtccctcacgccctaccgaccaaacgggcccaagtccggtccttccccctggccgccctgcctccacggcgaccaccgtccgaagacgcacgacgccggcccgtcggccg

SEQ ID NO: 399745 - DNA, 555 bp, Homo sapiens
  misc_feature: GZ8MTXP02HHIDZ.19.86.H09.1.454.CMB.2.raw
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctggcgacacggccntgtattattgtgcgaggcaggacggggctaaaggcagtaaagtggttaccgaccccgtggggccagggaaccctggtcaccgtctcctcacgcctccgaccgaacgggcccagtccggtccttcccccgtcggccgcccgtgcctccgacggacgccaccctccgaacgacgcacgacgccggcccgtcggtccg

SEQ ID NO: 399746 - DNA, 574 bp, Homo sapiens
  misc_feature: GZ8MTXP02GWYA9.19.86.H09.1.454.CMB.2.raw
  modified_base (320)..(320): a, c, t, g, unknown or other
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgtatccaggtggtagtggtggcgcatacgtcgcacagaagtttcagggccgcgtcaccatggccaaggtcgcgtccacgaatacagtntatatggacttgagcagcctgaggtctgacgacacggccntgtattattgtgcgaggcgagggacggggactaaaggcaagtaaagtggttaccgaccccgtggggccgagggaccccgtggtccaccggtcctcctcacgccctccgaccgacgggcccacgtccggtcctcccccgtcggccgcccgtcgcctcccgacggaccgccaacccgtccgaacgacgaccacgacggccggccccgtcgggcccg

SEQ ID NO: 399747 - DNA, 506 bp, Homo sapiens
  misc_feature: GZ8MTXP02HC437.19.86.H09.1.454.CMB.2.raw
  modified_base (265)..(265): a, c, t, g, unknown or other
  modified_base (302)..(302): a, c, t, g, unknown or other
  modified_base (420)..(420): a, c, t, g, unknown or other
tcagtactctcgtgcacgaccggtgctcgatttagtgctatagacttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctggtaccaanatcaacccaaataaacgcccccaaactcatcatttangatgccactaagcggcctcaggggtttctaatcgtcttcctctggctccaagtctggcaacacggcctccctgacaatctctgggctccagctgaggcgagctgattacactgctgcncatactgcaggtcgtatctcttatcgttctcggaactgggaaccaggtcaccgtctaggtcacgacccaggccaacccactgtacc

SEQ ID NO: 399748 - DNA, 535 bp, Homo sapiens
  misc_feature: GZ8MTXP02ITEJA.19.86.H09.1.454.CMB.2.raw
  modified_base (487)..(487): a, c, t, g, unknown or other
  modified_base (492)..(492): a, c, t, g, unknown or other
  modified_base (496)..(496): a, c, t, g, unknown or other
  modified_base (506)..(506): a, c, t, g, unknown or other
  modified_base (511)..(511): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgagtctgacgacacggcatgtattattgtgcgaggcgaggacggggactaaaggcaataaaggtggttacgaccccgtggggaccaggggaaccctggtaccaccgtctcctcacgcctaccacaacgggccatccgtcctccccnggccncctncctcacgacnccacnccgaagcgcacagccggcctggcg

SEQ ID NO: 399749 - DNA, 641 bp, Homo sapiens
  misc_feature: GZ8MTXP02GEYTR.19.86.H09.1.454.CMB.2.raw
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggactaaagggcaagtaaagtggttaccgaccccgtgggggccaggggaaccctggtccaccgtctcctcacgccctccaccgaacgggcccagtccggtccttcccccgtggcccgccctgcctccgacgggacgccacccgtccggacgacgccacgacggccgggccccgtgggggcctcggcccgttcggggtaccgaaaacggggtacccttaacccgttacccccgaacgggaacggtaaccggttaacccgttaggggaacgggtccgggggaccgttacgggggaccgaaaaccggggg

SEQ ID NO: 399750 - DNA, 506 bp, Homo sapiens
  misc_feature: GZ8MTXP02GWF96.19.86.H09.1.454.CMB.2.raw
  modified_base (353)..(353): a, c, t, g, unknown or other
  modified_base (494)..(506): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacggtccggttttcggcggtagggaccaagctagaccgtctaagtcagcccaaggctcgccccctcggtcactctcgttccccaccctccctccacgagacgtactgacgcgggcgtcggacaaggcgcgaatgnnnnnnnnnnnnn

SEQ ID NO: 399751 - DNA, 562 bp, Homo sapiens
  misc_feature: GZ8MTXP02IP1BO.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgacggtggtagtggtggcgcatacgtcgcacagaagtttcagggccgcgtcaccatggccaaggtcgcgtccacgaatacagtgtatatggacttgagcagcctgagtctgacgacacggccatgtattagttgtgcggagggcgagggacggggactaaaggcaagtaaagtggttccgacccgtggggaccacgggaaccctggtcaccggtctcctcacgccctccgaccgaacggcccacgtccggtccttcccccgtggccgccctcgccgtccgacggacgccaccgtccgaagacgcacgacggccggccgtcggccg

SEQ ID NO: 399752 - DNA, 537 bp, Homo sapiens
  misc_feature: GZ8MTXP02FKFHM.19.86.H09.1.454.CMB.2.raw
  modified_base (303)..(303): a, c, t, g, unknown or other
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcncgtccacgaatacagtgtatatggacttgagcagcctgaggtctgacgacacggccatgtattattgtgcgaggcaggacggggctaaaggcataaagtgtcgaccctggggccagggaccctggtcaccgtctcctcacgcctcccaccaagggccccatccggtcttcccccgtggccgccctgcctccacggacgccacctcccgaagacgcacacgcggccctggggccg

SEQ ID NO: 399753 - DNA, 565 bp, Homo sapiens
  misc_feature: GZ8MTXP02HYHTT.19.86.H09.1.454.CMB.2.raw
  modified_base (163)..(163): a, c, t, g, unknown or other
  modified_base (353)..(353): a, c, t, g, unknown or other
  modified_base (554)..(565): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaatcgtcatctataatgacgctgagcggtccttaagggtccctgaccgattctctggcgagaggtctggcgcctcagcttcctggccatcagagggctccagtctgaagatgagctgatttatactgtcgcaatctgggatgacngtgtggaacggttccgggttttcggacgggagggaccgaaagtcgtggtacccgtcctaaagtacgaccgaaccgacgtaccgccccgtaccccgttcggaccctaccttccgttacccgttcccctaccccttcccacccgacgtacgtaaccgttacgacggacggccggtacgcggacggacggccgacgtaagcgcnnnnnnnnnnnn

SEQ ID NO: 399754 - DNA, 484 bp, Homo sapiens
  misc_feature: GZ8MTXP02FED86.19.86.H09.1.454.CMB.2.raw
  modified_base (468)..(468): a, c, t, g, unknown or other
  modified_base (475)..(475): a, c, t, g, unknown or other
  modified_base (478)..(478): a, c, t, g, unknown or other
  modified_base (480)..(484): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagcttccctggccatcagagggctccagtctgaagatgaggctgatatactgtgcaatctgggatgacagtgtgaaacggtccgggttttcgcggagggaccaaagctgaccgtctaagtcagcccaaggctgccccctggtccactctcgttccccaccctcctcaccgagagtactgagcgggcgngacagcncanannnnn

SEQ ID NO: 399755 - DNA, 612 bp, Homo sapiens
  misc_feature: GZ8MTXP02HZY1H.19.86.H09.1.454.CMB.2.raw
  modified_base (136)..(136): a, c, t, g, unknown or other
  modified_base (197)..(197): a, c, t, g, unknown or other
  modified_base (259)..(259): a, c, t, g, unknown or other
  modified_base (359)..(359): a, c, t, g, unknown or other
tcagtactctcgtgcacgaccggtgctcgatttagtgctatagactttgggtttgggggaagaggaagactgacggcccccactcccaggtgcagctggtgcagtctggggctgaggtgaaggagcctggggcctnagtgaaggtctcctgcgaggcttttggatacaccttcagtcattatcatatactctgggtncgacacggcccctggacaagggcttgagtggatagggcgatccgaggtggtagtggtggcgnatacgtcgcacagaagttcagggccgcgtcaccatggccaaggtcgcgtccagaatacagtgtatatggacttgagcagcctgagtctgacgacacggcntgtaattattgtgcgagcagggacggggactaaaggcaagtaaaagtgggttaccgaccccggtggggacccgacggggaaacccgtggtcctaccggtctccctcgacgccccaccgaacccgaaacgggccccctaacgtcccggttcccttccccccgtcggtcccgccccgttcggccctacccgacgggaccgcccgaacccgcccggaacgacgaccaaccgacggcccggccccgttcggggcccg

SEQ ID NO: 399756 - DNA, 548 bp, Homo sapiens
  misc_feature: GZ8MTXP02FT13T.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccatggccaaggtcgcgtccacgaatacagtgtatatggacttgagcagcctgagtctgacgacacggcatgtattatgtgcgaggcagggacggggctaaagggcagtaaagtggttcgacccgtggggccagggaaccctgggtccaccgtctcctcacgccctaccaccgaacgggcccacgtccggtccttcccccgtggcccgcccctgcctccgacggcgccaacctccgaagacgcacagtccggcccgtgggcc

SEQ ID NO: 399757 - DNA, 486 bp, Homo sapiens
  misc_feature: GZ8MTXP02FFDYK.19.86.H09.1.454.CMB.2.raw
  modified_base (349)..(349): a, c, t, g, unknown or other
  modified_base (468)..(469): a, c, t, g, unknown or other
  modified_base (479)..(486): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgattctctggcgagaggtctggcgcctcagccttcctggccatcagagggctccagtctgaagatgaggctgatatactgtgcaatctgggatgacngtgtgtaacggttcggtttcgcggagggaccaagctcgaccgtctaagtcagcccaagcctcgccccctcggtccactctcgttccccaccctcctccacgacgacgtactgagcgggnnggcagcgcannnnnnnn

SEQ ID NO: 399758 - DNA, 563 bp, Homo sapiens
  misc_feature: GZ8MTXP02FPNV3.19.86.H09.1.454.CMB.2.raw
  modified_base (362)..(362): a, c, t, g, unknown or other
  modified_base (373)..(373): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccagtcggccaaggtccgcgtccaacgaatacagtgtatatggacttgagcagcctgagtctgacgacacggcntgtattattgngcgaggcgagggacgggactaaaggcaagtaaagtggtaccgacccgtggggccacgggaccctggccaccgtcgtcctcgacgcctacccacgaacgggccctacgtccggtccttcccccgtggcccgcccgtgcccgtccgacggacgaccaccgtccgaagcgacacgacgccggccgtcgggccg

SEQ ID NO: 399759 - DNA, 518 bp, Homo sapiens
  misc_feature: GZ8MTXP02GCMXQ.19.86.H09.1.454.CMB.2.raw
  modified_base (353)..(353): a, c, t, g, unknown or other
  modified_base (478)..(478): a, c, t, g, unknown or other
  modified_base (506)..(506): a, c, t, g, unknown or other
  modified_base (508)..(518): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgagctgattattactgtcgcaatcgtgggatgacngtgtagaacgggttccggtttcggcgggagggaccaagctgaccgtctaagtcacgccaaggctcgccccctgtcactctcgttcccgccctccctccaccgagacgtacgtacggaggccgggngtcgggacgaacgggcgaccgataacgncnnnnnnnnnnn

SEQ ID NO: 399760 - DNA, 547 bp, Homo sapiens
  misc_feature: GZ8MTXP02IM9YX.19.86.H09.1.454.CMB.2.raw
  modified_base (356)..(356): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagtttcagggccgcgtcaccatggccaaggtcgcgtccacgaatacagtgtatatggacttgagcagcctgagtctgacgacacggcntgtattattgtgcgagcgaggacgggctaaaggcagtaaaagtggttccgaccccgtggggaccacgggaaccctggtccaccgtctccctcacgccctccaccaacgggcccacgtccgtcctccccgtcggccgccctgcctccgacggcgaccaccgtccgaagacgcacgacgccggcccgtggccg

SEQ ID NO: 399761 - DNA, 512 bp, Homo sapiens
  misc_feature: GZ8MTXP02GOX38.19.86.H09.1.454.CMB.2.raw
  modified_base (318)..(318): a, c, t, g, unknown or other
  modified_base (352)..(352): a, c, t, g, unknown or other
  modified_base (474)..(474): a, c, t, g, unknown or other
  modified_base (494)..(494): a, c, t, g, unknown or other
  modified_base (499)..(499): a, c, t, g, unknown or other
  modified_base (501)..(512): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagntgaggctgattatactgtgcaatctgggatgacnggtgtggtaacggttccggttttcgggcgggtagggaccaaagctaggaccgtctaagtcagcccgaaggctacgccccctggtcactcttcgttcccgccctcctccacgacgacgttacngacgcgggctgggcaaggcncaagngnnnnnnnnnnnn

SEQ ID NO: 399762 - DNA, 526 bp, Homo sapiens
  misc_feature: GZ8MTXP02JPYEN.19.86.H09.1.454.CMB.2.raw
  modified_base (163)..(163): a, c, t, g, unknown or other
  modified_base (261)..(261): a, c, t, g, unknown or other
  modified_base (357)..(357): a, c, t, g, unknown or other
  modified_base (514)..(514): a, c, t, g, unknown or other
  modified_base (516)..(526): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcaagaaagtcccaggaaccggcccccaaatcgtcatctataatgacgctgagcggtcttaagggtccctgaccgattcnctggcgagaggtctggcgcctcagcttccctggccatcagagggctccagtctgaagatgaggctgatttatactgtcgcaatcgtagggatgacnggtgtaggaaccggttccggtttggcggagggtaccaagcgtagaccgtctaagtcacgcccaaggctcgcccctgtcactctcgttccccgccctcctccacgacgtacgtactggacggtccggggactcgggcgaaacgggcgacgtaaagcgncnnnnnnnnnnn

SEQ ID NO: 399763 - DNA, 544 bp, Homo sapiens
  misc_feature: GZ8MTXP02GR25F.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgagtctgacgacacggcatgtattatgtgcgagcaggacggggctaaaggcagtaaagtggttcgaccccgtggggccagggaaccctggtcaccgtctcctcacgcctccaccaacgggcccacgtccggtcctcccccgtggccgcccctgcctccacggcgccaccgtccgaacgacgccacgacgccggcccgtcgggcc

SEQ ID NO: 399764 - DNA, 563 bp, Homo sapiens
  misc_feature: GZ8MTXP02F7JOA.19.86.H09.1.454.CMB.2.raw
  modified_base (357)..(357): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtggcgcatacgtcgcacagaagttcagggccgcgtcaccatggccaaggtcgcgtccacgaatacagtgtatatggacttgagcagcctgagtctgacgacacggcntgtattatgtgcgaggcagggacgggactaaaggcaagtaaagtcggtccgacccgtggggccacgggaccctggtccaccgtctcctcacgcctccaccgacggcccacgtccggtccttcccccgtcggcccgccccgttgcccgtaccgacggacgccgacccgtccgaacgacgaccgacgacggccggcccgtcgggtccg

SEQ ID NO: 399765 - DNA, 567 bp, Homo sapiens
  misc_feature: GZ8MTXP02F7DRW.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccgcgtcaccatggccaaggtcgcgtccacgaatacagtgtatatggacttgagcagcctgagtctgacgacacggccatgtattagttgtgcgaggcgagggacggggacgtaaaggacagtaaagtggtcgaccccgtcggggccgacgggaaccgtcggtcaccgtctcctcacgcctccgaccaacggcccgacgtccggtccttccccgtcggccgcccgtcgcctccgacggacgccgacccgtccgaacgacgacgacacggccggaacccgtcggtccg

SEQ ID NO: 399766 - DNA, 677 bp, Homo sapiens
  misc_feature: GZ8MTXP02H25FA.19.86.H09.1.454.CMB.2.raw
  modified_base (194)..(194): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatatctgggtncgacaggcccctggacaagggcttgagtggatagggcggatccagggtggtagtgggtggcgcatacgtcgcacagaagtttcagggccgcgtcaccatggccaaggtcgcgtccacgaatacagtgtatatggacttgagcagcctgaggtctgacgacacggccatcgtattagttgtgcggagcgagggacggggactaaaggctaaagtaaacggttcgggttaccggacccccggttagggggaccccgtacgggggtaaaccccgtcggggttacccgaacccggttccttccccgtaccgaccggtcccccgttaccgaaaccccggaaaccggggtccccctaacggttccccggttacccgtttccccccgtcgggtccccgtcccccgtttcggacccttacccgacgggaccgacccgtacccgtaccggaacgacgtaccgaaccgacggtcccgggcccgttcgggcccg

SEQ ID NO: 399767 - DNA, 514 bp, Homo sapiens
  misc_feature: GZ8MTXP02HMXBE.19.86.H09.1.454.CMB.2.raw
  modified_base (355)..(355): a, c, t, g, unknown or other
  modified_base (499)..(499): a, c, t, g, unknown or other
  modified_base (502)..(514): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgtattctctggcgagaggtctggcgcctcagcttcccctggccatcagagggctccagtctgaagatgaggctgatttatactgtgcaatctgggatgacngtgtgaacggttccgtttcgggcggagggacccaagctgaccgtactaagtcacgcccaaggctcgccccctcggtccactctcgtttcccgccctccgtcccacgacgacgtactgacgcgggcgcggacgaaggcgactaanagnnnnnnnnnnnnn

SEQ ID NO: 399768 - DNA, 533 bp, Homo sapiens
  misc_feature: GZ8MTXP02F561Y.19.86.H09.1.454.CMB.2.raw
  modified_base (195)..(195): a, c, t, g, unknown or other
  modified_base (359)..(359): a, c, t, g, unknown or other
  modified_base (502)..(502): a, c, t, g, unknown or other
  modified_base (510)..(510): a, c, t, g, unknown or other
  modified_base (518)..(518): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccacggtggtagtggtggcgcatacgtcgcacagaagttcagggccgcgtcaccatggccaaggtcgcgtccacgaatacagtgtatatggacttgagcagcctgagtctgacgacacggccntgtattattgtgcgaggcaggacgggctaaaggcataaagtgttcgacccgtgggcacgggaacctggtcaccgtctccgtcacgcctccaccgaacggcccacgtccgtcttcccccgtcggccgccctgctccacggcgcncctaccgngacgcacncgcggccctgggccg

SEQ ID NO: 399769 - DNA, 557 bp, Homo sapiens
  misc_feature: GZ8MTXP02F446N.19.86.H09.1.454.CMB.2.raw
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctgacgacacggccntgtattattgtgcgaggcagggacggggctaaaggcaataaagtggttcgacccgtggggccgagggaaccctggtcaccgtctcctcacgcctacccaccgaacggccccagtccggtccttcccccgtggccgccctgcctccgacggacgccacccgtaccgaacgacgccacgacgccggcccgtggggtccg

SEQ ID NO: 399770 - DNA, 584 bp, Homo sapiens
  misc_feature: GZ8MTXP02JO2Y0.19.86.H09.1.454.CMB.2.raw
  modified_base (347)..(347): a, c, t, g, unknown or other
  modified_base (359)..(359): a, c, t, g, unknown or other
  modified_base (369)..(369): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgagtcngacgacacggcntgtatattgngcgaggcgagggacggggactaaaggcaagtaaagtggttaccgaccccggtcggggaccgacgggaacccgtcggtccgacccgtctcccgtcgacgccctccaccgaacgggcccacgtccggtccttcccccgtcggcccgtccctcgccgtcccgacgggaccgaccgaccctccggaacgacgaccacgacggcccggcccggtggcccg

SEQ ID NO: 399771 - DNA, 562 bp, Homo sapiens
  misc_feature: GZ8MTXP02GVI6S.19.86.H09.1.454.CMB.2.raw
  modified_base (347)..(347): a, c, t, g, unknown or other
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccgcgtcaccatggccaaggtcgcgtccacgaatacagtgtatatggacttgagcagcctgaggtcngacgacacggccntgtaattattgtgcgaggcgagggacggggactaaaggcaataaaggtggttccgaccccgtggggaccgacgggacccgtggtccaccgtctcctcacgccctccgaaccgacgggccactccggtcctcccccgtgcccgcccgtcgcctccgaggcgccgaccctccgaagacgccgacgacggcccggccgtcggccg

SEQ ID NO: 399772 - DNA, 570 bp, Homo sapiens
  misc_feature: GZ8MTXP02FVA8Q.19.86.H09.1.454.CMB.2.raw
  modified_base (304)..(304): a, c, t, g, unknown or other
  modified_base (359)..(359): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagttcagggccgcgtcaccatggccaaggtcncgtccacgaatacagtgtatatggacttgagcagcctgagtctgacgacacggcntgtattattgtgcgaggcgagggacggggactaaaggcaagtaaagtggttccggacccgtggggccacgggaccctggtccaccggtctcctcacgccctaccaccgaacgggcccacgtccggtcccttcccccgtgggtcccgcccgtgcccgtccgacggacgaccacccgtaccgaagacgacaccgacggccggcccgtcggccg

SEQ ID NO: 399773 - DNA, 531 bp, Homo sapiens
  misc_feature: GZ8MTXP02JGVQ8.19.86.H09.1.454.CMB.2.raw
  modified_base (388)..(388): a, c, t, g, unknown or other
  modified_base (393)..(393): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgagcaggacgggctaaaggcataaagtggttcgaccctggggccagggaaccctggtccaccgtcncctcngcctccaccaagggcccatccggtcttccccctgcgccctgctccagagcacctccgagagcacacgcggccctgggcctgccgtggtcaaggacctaccttcccacgagaacgtacgtcgacgcggctcggcaacgg

SEQ ID NO: 399774 - DNA, 529 bp, Homo sapiens
  misc_feature: GZ8MTXP02HXJTV.19.86.H09.1.454.CMB.2.raw
  modified_base (163)..(163): a, c, t, g, unknown or other
  modified_base (339)..(339): a, c, t, g, unknown or other
  modified_base (518)..(529): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggccccaaatcgtcatctataatgacgctgagcggtcttaagggtccctgaccgattctctggcgagaggtctggcgcctcagcttccctggccatcagagggctccagtctgaagatgaggctgatttatactgtcgntaatcgtgggatgacagtgtagtaacgggttccggtttcgggcggagggaccaagctacgaccgtctaagtccagccccgaagccgtccgccccgtcggtacctacctctccgtttccccaccccttcctcccacgacgtactacgtgacgcgggtctacgggcaaggcgacagtagcnnnnnnnnnnnn

SEQ ID NO: 399775 - DNA, 482 bp, Homo sapiens
  misc_feature: GZ8MTXP02FLUIT.19.86.H09.1.454.CMB.2.raw
  modified_base (324)..(324): a, c, t, g, unknown or other
  modified_base (477)..(482): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgcccaaactcgtcatctataatgacgctgagcggtccttaagggccctgactgattctctggcgagaggtctggcgcctcagcttcccctggccatcagagggctccagtctgaagatgaggctgnttattactgtgcaatctgggatgcagtgtgaacgtccgttttggcgagggacccaaagctgacgtcctaaagtcagcccaaggctgccccctcggtcactctgttcccgccctcctcccacgagagtactgagcggctggcaaggcgcatagnnnnnn

SEQ ID NO: 399776 - DNA, 303 bp, Homo sapiens
  misc_feature: GZ8MTXP02ICYGW.19.86.H09.1.454.CMB.2.raw
  modified_base (298)..(303): a, c, t, g, unknown or other
tcagtactctcgtgcacgaccggtgctcgatttagtgctatagacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggctacttcccacgagagtactgagcgggctgggcaaggcgcatagnnnnnn

SEQ ID NO: 399777 - DNA, 499 bp, Homo sapiens
  misc_feature: GZ8MTXP02IVY6I.19.86.H09.1.454.CMB.2.raw
  modified_base (352)..(352): a, c, t, g, unknown or other
  modified_base (487)..(487): a, c, t, g, unknown or other
  modified_base (489)..(499): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattctctggcgagaggtctggcgcctcagcttccctggccatcagagggctccagtctgaagatgaggctgattatactgtgcaatctgggatgacngtgtgaacgggtccgtttcgggcggagggaccaagctgaccgtcaagtcagcccaagctcgcccctggtcactctcgttcccaccctcctcccacgagacgtactgacgcgggctggacgaggcgccaagtcgcncnnnnnnnnnnn

SEQ ID NO: 399778 - DNA, 495 bp, Homo sapiens
  misc_feature: GZ8MTXP02FGFZI.19.86.H09.1.454.CMB.2.raw
  modified_base (353)..(353): a, c, t, g, unknown or other
  modified_base (476)..(476): a, c, t, g, unknown or other
  modified_base (487)..(487): a, c, t, g, unknown or other
  modified_base (489)..(495): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgagatgaggctgatattactgtgcaatctggggatgacngtgtgaacggtccggttttcggcgggagggaccaaagctgacccgtctaagtcagcccaaggctgccccctcggtcacgtctcgttccccacccttcctccacgagacgtactgagcgggtcnggcaggcgcanannnnnnn

SEQ ID NO: 399779 - DNA, 553 bp, Homo sapiens
  misc_feature: GZ8MTXP02IBUJU.19.86.H09.1.454.CMB.2.raw
  modified_base (195)..(195): a, c, t, g, unknown or other
  modified_base (359)..(359): a, c, t, g, unknown or other
  modified_base (386)..(386): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctgacgacacggcntgtattattgtgcgagcaggacggggntaaaggcaagtaaagtggttacgacccgtggggccgacgggaaccctggtcaccgtctcctcacgcctccaccgaacgggcccacgtccggtccttcccccgtcggccgccctcgcctccgacggacgccaccctccgaacgacgccacacgccggcccgtcggccg

SEQ ID NO: 399780 - DNA, 556 bp, Homo sapiens
  misc_feature: GZ8MTXP02GXFAW.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgagtctgacgacacggcntgtattattgtgcgaggcaggacggggactaaaggcaagtaaagtggtacgaccccgtggggccagggaaccctggtcaccgtctcctcacgccctccaccgaacgggcccagtccggtccttcccccgtggcccgcccctggcctccgacggacgccaaccgtccgaagacgaccacgacggccggcccgtgggccg

SEQ ID NO: 399781 - DNA, 590 bp, Homo sapiens
  misc_feature: GZ8MTXP02J3VON.19.86.H09.1.454.CMB.2.raw
  modified_base (284)..(284): a, c, t, g, unknown or other
  modified_base (347)..(347): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtattggtggcgcatacgtcgcacagaagtttcagggccncgtcacatggccaaggtcgcgtccacgaatacagtgtatagtggacttgagcagcctgaggtngacgacacggcatgtattatgtgcgaggcaggacggggctaaaggcagtaaacgtgggttacgacccccgtcggggtcccgacggggaaccccgtcgggttaccacccggttcctcccgtacacgccccgtccaccccgaacggggaccccacgtcccgtccgttcccccgtcggtcccgcccgtcgccgtccacggacgccaccgtccgaacgacgcgacgtacggccggcccgtgggtccg

SEQ ID NO: 399782 - DNA, 502 bp, Homo sapiens
  misc_feature: GZ8MTXP02JT6Q7.19.86.H09.1.454.CMB.2.raw
  modified_base (259)..(259): a, c, t, g, unknown or other
  modified_base (263)..(263): a, c, t, g, unknown or other
  modified_base (358)..(358): a, c, t, g, unknown or other
  modified_base (417)..(417): a, c, t, g, unknown or other
  modified_base (430)..(430): a, c, t, g, unknown or other
  modified_base (474)..(474): a, c, t, g, unknown or other
  modified_base (491)..(502): a, c, t, g, unknown or other
tcagtactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggttccttaagggtccctgaccgnttcnctggcgagaggtctggcgcctcagcttccctggccatcagaggggctccagtctgaagatgaggctgattatactgtgcaatcgtagggatgacngtgtgacggtcggtttcggcggtagggaccagcgtgaccgtcgtagtcagcccaaggcncgccccctggtcnctctcgtcccaccctccctcacgagacgtacgtgaggccggtcnggacaggcgacagtagnnnnnnnnnnnn

SEQ ID NO: 399783 - DNA, 590 bp, Homo sapiens
  misc_feature: GZ8MTXP02FLDXW.19.86.H09.1.454.CMB.2.raw
  modified_base (578)..(578): a, c, t, g, unknown or other
  modified_base (580)..(590): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacgccccaaatcgtcatctataatgacgctgagcggtccttaagggtccctgaccgtattctcgtggcgagaggtctggcgcctcagcttccctggccatcagagggctccagtctgaagatgagctgattatactgtgacaatctgggatgactgtgtacggtaacgggttccgggttttacgggcggggtaacgggacccaaagccgttacggtacccgtaccttaaacggtcccgacggaccccgtaaaggtcccttacccggcccccccgttcgggtaccctacccgttccgttcccgttcccccggtcccccttacccgtcctacggacgtacgtactggacggcgggtcgtacgggacaacgggcgacaagtcgncnnnnnnnnnnn

SEQ ID NO: 399784 - DNA, 553 bp, Homo sapiens
  misc_feature: GZ8MTXP02I7RD2.19.86.H09.1.454.CMB.2.raw
  modified_base (195)..(195): a, c, t, g, unknown or other
  modified_base (358)..(358): a, c, t, g, unknown or other
  modified_base (515)..(515): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtgcgcatacgtcgcacagaagtttcagggccgcgtcaccatggccaaggtcgcgtccacgaatacagtgtatatggacttgagcagcctgaggtctgacgacacggcntgtattattgtgcgaggcgagggacgggctaaaggcaataaagtggttccgacccgtggggccgacgggaccctggtccaccgtctcctcagccctaccaccgaacgggccccacgtccggtccttcccccgtggcccgccctcgctccgacggtcnccgacctccgaagacgcacgagccggcccgtcggtccg

SEQ ID NO: 399785 - DNA, 553 bp, Homo sapiens
  misc_feature: GZ8MTXP02HQD77.19.86.H09.1.454.CMB.2.raw
  modified_base (195)..(195): a, c, t, g, unknown or other
  modified_base (360)..(360): a, c, t, g, unknown or other
  modified_base (496)..(496): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagtttcagggccgcgtcaccatggccaaggtcgcgtccacgaatacagtgtatatggacttgagcagcctgaggtctgacgacaccggcntgtattattgtgcgaggcagggacggggactaaaggcaagtaaagtggttccgacccgtggggaccagggaaccctggtccaccgtctcctcacgccctccaccgaacgggcccagtccgtcctcccccgtggccncccgtgcctccgacggacgcaaccgccgaagcgaccacgacgccggcccgtgggccg

SEQ ID NO: 399786 - DNA, 607 bp, Homo sapiens
  misc_feature: GZ8MTXP02IWR5R.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcagggccgcgtcaccatggccaaggtcgcgtccacgaatacagtgtatatggacttgagcagcctgagtctgacgacacggccatgtattattgtgcgagcagggacgggctaaaggcaagtaaagtggttcgacccgtggggccagggaaccctggtcaccgtctcctcgacgccctaccgaccgaacggggcccaacgtccgggttccttccccccgtcgggtcccgcccccgtcggtcccgtacccgaacgggaccgacccgaccccgtacccggaacgaaacggccgaaacccgacgggtccccgggaccccgttcgggggccccg

SEQ ID NO: 399787 - DNA, 688 bp, Homo sapiens
  misc_feature: GZ8MTXP02FUAT0.19.86.H09.1.454.CMB.2.raw
  modified_base (163)..(163): a, c, t, g, unknown or other
  modified_base (297)..(297): a, c, t, g, unknown or other
  modified_base (676)..(676): a, c, t, g, unknown or other
  modified_base (678)..(688): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgcccccaaatcgtcatctataatgacgctgagtcggttcttaagggtccctgaccgattctcgtggcgagaggtctggcgcctcacgtccttcccgnggccatcgaggcgggcctcagtctagaagtatgaggtcttagtatttatacgtgtacgactaagtcgtgggtataggacgtgggttcggtaacggggtttaacccgggggtttcccggggttttcgggggaccgggggtaacggggtaacccgtaaacgggtccgttaaccggtaaccccggttaccgttaaacggtacccgaaccggtacccccggtaaacgggtccccgttccccggtacccccccgttcgggttacccctaacccgttccccgttccccggtttaccccccgtacccccttccccgtaacccgaaccgtacggtaacgtacgtacgggacggtcgggcgtacggacggaacggccgacgagtacgncnnnnnnnnnnn

SEQ ID NO: 399788 - DNA, 576 bp, Homo sapiens
  misc_feature: GZ8MTXP02F4X0H.19.86.H09.1.454.CMB.2.raw
  modified_base (260)..(260): a, c, t, g, unknown or other
  modified_base (319)..(319): a, c, t, g, unknown or other
  modified_base (565)..(566): a, c, t, g, unknown or other
  modified_base (568)..(576): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggtccttaagggtccctgaccgattcnctggcgagaggtctggcgcctcagcttccctggccatcagagggctccagtctagaagntgaggctgattatactgtgcaatcgtaggggatgactaggtggtggtaaaccgggttccgggttttcgggacggggaacgggtaccaaaggctacggacccgtaccgtaagtccacgccccgaaaggccgtcgccccccgtcgggttaccaccttccgttcgttcccccgcccccttccccttacccgaacccggtaacgttacctcggaacggccggggctcgggaccgaagggcgccgagtagnncnnnnnnnnn

SEQ ID NO: 399789 - DNA, 557 bp, Homo sapiens
  misc_feature: GZ8MTXP02JUINE.19.86.H09.1.454.CMB.2.raw
  modified_base (194)..(194): a, c, t, g, unknown or other
  modified_base (282)..(282): a, c, t, g, unknown or other
  modified_base (333)..(333): a, c, t, g, unknown or other
  modified_base (358)..(358): a, c, t, g, unknown or other
  modified_base (385)..(385): a, c, t, g, unknown or other
  modified_base (492)..(492): a, c, t, g, unknown or other
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccaggtggtagtggtggcgcatacgtcgcacagaagtttcagggccngtcaccatggccaaggtcgcgtccaacgaatacagtgtatatggacttgancagcctggagtctgacgacacggcntgtattatgtgcgagcagggacggggntaaaggcaataaagtggtacgacccgtggggaccagggaaccctggtcacccggtctcctcgacgccctccacccgaacggggccccaagtccggtccttcccccgnggtccgccctcgccgtccacggacgccgacctccgaagacgcacgacggtcccggccgtgggccg

SEQ ID NO: 399790 - DNA, 542 bp, Homo sapiens
  misc_feature: GZ8MTXP02FURRR.19.86.H09.1.454.CMB.2.raw
  modified_base (283)..(283): a, c, t, g, unknown or other
  modified_base (360)..(360): a, c, t, g, unknown or other
  modified_base (371)..(371): a, c, t, g, unknown or other
  modified_base (486)..(486): a, c, t, g, unknown or other
  modified_base (508)..(508): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccncgtcaccatggccaaggtcgcgtccacgaatacagtgtatatggacttgagcagcctgaggtctagacgacacggcntgtattattgngcgaggcgagggacgggactaaaggcaagtaagtggtccgacccgtggggccgacgggacctggtccaccgtctcctcacgcctaccaccgacggccctagtccgtcctccccgnggcccgcctgcctccgacggcnccacctcgaagcgcacgacgccggcccgtggccg

SEQ ID NO: 399791 - DNA, 704 bp, Homo sapiens
  misc_feature: GZ8MTXP02G8OEC.19.86.H09.1.454.CMB.2.raw
  modified_base (163)..(163): a, c, t, g, unknown or other
  modified_base (318)..(318): a, c, t, g, unknown or other
  modified_base (688)..(688): a, c, t, g, unknown or other
  modified_base (695)..(695): a, c, t, g, unknown or other
  modified_base (697)..(697): a, c, t, g, unknown or other
  modified_base (699)..(699): a, c, t, g, unknown or other
  modified_base (703)..(703): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcggtccttaagggtccctgaccgattctcgtggcgagaggtctggcgcctcagcttcctggccatcagagggctccagtctagaagntgaggctgattattactgtcgacaattcgtaggggatggaactggttggtaggtaaacccgggggtttcccgggtttttacggggacggggtaacggggaaaccccgtaaaggtccgttacggtaacccgttaccgttaaaacggttccgaacggacccccgaaaggggtccctacccgggtacccccccgttcggggttaccctaacccgtttccgttaccccggtttaccccctaacccccgtttcccccgttaccccgaaaccggtaaccggtaaccggtttaaccgtacgggtaaccgggaccggggtcgttacggggaccgtaaaccgggggccggtacccaaacgggttacgcgacgacgacgngcgcgcncncncacng

SEQ ID NO: 399792 - DNA, 567 bp, Homo sapiens
  misc_feature: GZ8MTXP02JT3V2.19.86.H09.1.454.CMB.2.raw
  modified_base (284)..(284): a, c, t, g, unknown or other
  modified_base (359)..(359): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtggcgcatacgtcgcacagaagtttcagggccncgtcaccatggccaaggtcgcgtccacgaatacagtgtatatggacttgagcagcctgagtctgacgacacggcntgtattattgtgcgaggcgagggacggggactaaaggcaagtaaagtggttccgaccccgtgggggacccgacggggaacccgtggtccaccgtctccctcgacgcctacccaccgaacgggcccagtccggtcctcccccgtcggccgccctgcctccgacggacgccacccgtcgaacgcgccacgacggccgcccgtgggtcccg

SEQ ID NO: 399793 - DNA, 556 bp, Homo sapiens
  misc_feature: GZ8MTXP02FTDPZ.19.86.H09.1.454.CMB.2.raw
  modified_base (336)..(336): a, c, t, g, unknown or other
  modified_base (373)..(373): a, c, t, g, unknown or other
  modified_base (521)..(521): a, c, t, g, unknown or other
  modified_base (529)..(529): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagttcagggccgcgtcaccatggccaaggtcgcgtccacgaatacagtgtatatggacttgagnagcctgaggtctgacgacacggccatgtattattgtncggagggcgagggacggggctaaaggcaagtaaagtggtcgacccgtggggccacgggaccctggccaccgtctcctcgacgcctacccaccgaacgggcccaagtcggtccttcccccgtggccgccccgttcgcctccgacggacnccgacccncgaacgcgcacgcggccggccgcggcg

SEQ ID NO: 399794 - DNA, 560 bp, Homo sapiens
  misc_feature: GZ8MTXP02JNOPE.19.86.H09.1.454.CMB.2.raw
  modified_base (482)..(482): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgagtctgacgacacggccatgtatatgtgcgagcaggacgggctaaagcataaagtgttacgacccgtggggccacgggaaccctggtccaccgtctcctcgacgcctccaccgaacgggcccacgtccggtccttcccccgnggcccgcccgtcggccctacccgacggtacgccgacccgtccgaacgacgaccgacgacggcccggcccgtgggcccg

SEQ ID NO: 399795 - DNA, 581 bp, Homo sapiens
  misc_feature: GZ8MTXP02GO67D.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagttcagggccgcgtcaccatggccaaggtcgcgtccacgaatacagtgtatatggacttgagcagcctgagtctgacgacacggcntgtattatgtgcgaggcagggacgggactaaaggcaagtaaagtggttaccgacccgtggggaccagggaaccctggtcaccgtctccgtcacgccctacccgaaccgaacgggccccagttcccgggtccctttcccccgcgggcccgtcccccgtcggcccgtacccgacggacgccacccgtcccgaagacgaccaccgacgccggccccgtggggtccg

SEQ ID NO: 399796 - DNA, 531 bp, Homo sapiens
  misc_feature: GZ8MTXP02FLM7Z.19.86.H09.1.454.CMB.2.raw
  modified_base (283)..(283): a, c, t, g, unknown or other
  modified_base (360)..(360): a, c, t, g, unknown or other
  modified_base (448)..(448): a, c, t, g, unknown or other
  modified_base (486)..(486): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtgcgcatacgtcgcacagaagtttcagggccncgtcaccatggccaaggtcgcgtccacgaatacagtgtatatggacttgagcagcctgaggtctgacgacacggccntgtattattgtgcgaggcaggacggggactaaagggcaataaaagtggttaccgaccccgtggggccagggaaccctggtccacgtcncctcagcctccacaagggcccatcggtctcccctggcnccctgctccagacgcacctccgaagacgcacgacgcgcccgcggc

SEQ ID NO: 399797 - DNA, 516 bp, Homo sapiens
  misc_feature: GZ8MTXP02GEYG0.19.86.H09.1.454.CMB.2.raw
  modified_base (506)..(516): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttccctggccatcagagggctccagtctgaagatgagctgattatactgtgcatcgtggatgacagtgtgtaacgggttccggtttcggcggagggaccaagtctcggaccgtcgtaagtcgacgcccgaaggcctcgcccccgtggtcctactcctccgttccccgccccttcccgacacgacgtacgtgacggtcggcgtggacaacggcgctagagnnnnnnnnnnn

SEQ ID NO: 399798 - DNA, 560 bp, Homo sapiens
  misc_feature: GZ8MTXP02GJ487.19.86.H09.1.454.CMB.2.raw
  modified_base (494)..(494): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgagtctgacgacacggcatgtattattgtgcgaggcgagggacggggactaaaggcaataaagtcggtccgaccccgtggggaccacgggaaccctggtcaccgtctcctcacgcctccaccgacggcccatccggtccttccccgtggccnccccgtcgccgtcccgacggacgccgacccgtccgaacgacgccacgacgccggcccgtcgggccg

SEQ ID NO: 399799 - DNA, 540 bp, Homo sapiens
  misc_feature: GZ8MTXP02GWLO6.19.86.H09.1.454.CMB.2.raw
  modified_base (163)..(163): a, c, t, g, unknown or other
  modified_base (530)..(540): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaacggcacccaaactcgtcatctataatgacgctgagcggtcttaagggtccctgaccgtattctctggcgagaggtctggcgcctcagccttccctggccatcagaggctccagtctagaagatggagctgtattattctgtgactaagtcgtgggatgacgtgttggtaggtaacgggtttccgggtttcgggcgggtagggtaccagtcgtcgaccgtcctaagtcgacgcccgaaggcctccgcccctggccactctcgttccccaccctccctaccgacgacgacgtactggacggtcgggacgtcggaccgaagggcacgagtacgcnnnnnnnnnnn

SEQ ID NO: 399800 - DNA, 560 bp, Homo sapiens
  misc_feature: GZ8MTXP02FWSAP.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcgagggacggggactaaaggcaagtaaagtggttccgacccgtggggccgacgggaaccctggtccaccgtctcctcacgcctccaccgaacggcccacgtccggtccttcccccgtggcccgccctcgcctccgacggacgccgaccctccgaagacgccacgacgccggcccgtcgggccg

SEQ ID NO: 399801 - DNA, 646 bp, Homo sapiens
  misc_feature: GZ8MTXP02HUQEW.19.86.H09.1.454.CMB.2.raw
  modified_base (353)..(353): a, c, t, g, unknown or other
  modified_base (359)..(359): a, c, t, g, unknown or other
  modified_base (371)..(371): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgagggtggtagtggtggcgcatacgtcgcacagaagtttcagggccgcgtcaccatggccaaggtcgcgtccacgaatacagtgtatatggacttgagcagcctgagtctgacganacggcntgtattatgtgngaggcgagggtacgggactaaaggacaagtaaagttggttacccggacccggtcgggggacccgacggggtaacccgtcgggtacccgtaccgttaccgttccctaccgacggtaccccctacccgaaacccggaaccgggtaccccgaacggttccccggttacccgtttcccccgtccgggtcccgtccccgtccggtcccgtaccggacggaccgaccctacccggtaccgaacggcgaccgaccgacggcccggcccggttcgggtccccg

SEQ ID NO: 399802 - DNA, 665 bp, Homo sapiens
  misc_feature: GZ8MTXP02JNAKP.19.86.H09.1.454.CMB.2.raw
  modified_base (304)..(304): a, c, t, g, unknown or other
  modified_base (371)..(371): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcncgtccacgaatacagtgtatatggacttgagcagcctgagtctgacgacacggcatgtattagttgngcgaggcgaagggacggggctaaaaggcgaattaaaaggtggtaccggacccgtacgggggtcccgacgggggaaccccgtacgggtaccgtaacccggttccgttcccgttccgaccgggaccccttccccgaaccccgaaaacgggggtcccccaacggttaccccgggttacccgtttccccccgttcggggcccgtcccccgttcggcccttacccggacgggacgacccgaaccccgtcccggaacgaccggaccacccgacggacccgggccccgttacggggcccgg

SEQ ID NO: 399803 - DNA, 545 bp, Homo sapiens
  misc_feature: GZ8MTXP02F1OSW.19.86.H09.1.454.CMB.2.raw
  modified_base (358)..(358): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagttcagggccgcgtcaccatggccaaggtcgcgtccacgaatacagtgtatatggacttgagcagcctgagtctgacgacacggcntgtattattgtgcgaggcagggacggggactaaaggcagtaaagtggttcgacccgtggggccagggaaccctggtcaccgtctctcacgcctaccaccaacgggcccactccggtcctcccccgtggccgccctcgcctccacggacgccaccgtccgaagacgcgacacgccgcccgtcgggccg

SEQ ID NO: 399804 - DNA, 627 bp, Homo sapiens
  misc_feature: GZ8MTXP02FOYA4.19.86.H09.1.454.CMB.2.raw
  modified_base (163)..(163): a, c, t, g, unknown or other
  modified_base (327)..(327): a, c, t, g, unknown or other
  modified_base (615)..(627): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcaagaaacgtcccaggaaccgcccccaaatcgtcatctataatgacgctgagcggttaccttaagggtccctgaccgtattctcgtggcgagaggtctggccgcctcagtcttccctggccatcagagggctccgagtctgaagntgaggctgtattattactgtcgactaatgtaggggatgactggtggtacgggtaaaccgggtttccgggttttcgggacggggtaacggggaccaaaggtccgtacggtaacccgttaccgtaaaggtccgaacgaccccgtaaggcccgtccggtccccccgtcgggttaccctacccttccgttacccgttaccccctacccccttcccgttacccgaaccggtacggtaacgtaccgttacgggacgggtccgggcgtacgggacgaacgggccgacaaggacgnnnnnnnnnnnnn

SEQ ID NO: 399805 - DNA, 524 bp, Homo sapiens
  misc_feature: GZ8MTXP02I2AY5.19.86.H09.1.454.CMB.2.raw
  modified_base (510)..(510): a, c, t, g, unknown or other
tcagtactctcgtgcacgaccggtgctcgatttagtgctatagacttgggtttgggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcagtacgtcgcacagaagtttcagggccgcgtcaccatggccaggtcgcgtccacgaatacagtgtatatggacttgagcagcctgaggtctgacgacacggccatgtattattgtgcgaggcagggacggggataaagggcaagtaaagtggttcgacccgtggggccagggaccctggtccaccgtctccncacgcctcaacccg

SEQ ID NO: 399806 - DNA, 543 bp, Homo sapiens
  misc_feature: GZ8MTXP02JWHTC.19.86.H09.1.454.CMB.2.raw
  modified_base (362)..(362): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattatgtgcgagcaggacgggacctaaaggcataaaggtggttcgacccngtcggggccagggaaccctggtcaccgtctcctcagccctcaccaagggcccagtcggtcttccccctgccgccctgcctccgaggacgccaaccctccgagacgcacagcgccctgggctgccctggccaaggacctacgttccccaggaagtacgtacgtggacgcggggacgcggacg

SEQ ID NO: 399807 - DNA, 518 bp, Homo sapiens
  misc_feature: GZ8MTXP02JVHGR.19.86.H09.1.454.CMB.2.raw
  modified_base (356)..(356): a, c, t, g, unknown or other
  modified_base (509)..(518): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggccccaaatcgtcatctataatgacgctgagcggttccttaagggtccctgaccgattctctggcgagaggtctggcgcctcagcttccctggccatcagagggctccagtctgaagatgaggctgatttattactgtgcaatcgtgggatgacnggtgtaggtaaccgggttccgggtttcgggcggagggaccagctgacccgtctaagtcagcgcaaggctcgccccctcggtccactctcgttccccaccctccctccaccgagacgtacgtgacggcgggctcgggcacgggcgacagtacgnnnnnnnnnn

SEQ ID NO: 399808 - DNA, 603 bp, Homo sapiens
  misc_feature: GZ8MTXP02JZY66.19.86.H09.1.454.CMB.2.raw
  modified_base (432)..(432): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcagtaaagtggtcgaccctgggggccagggaaccctggtcaccgtctcctcacgcctccaccaagggcccagtccggtccttcccccgnggcccgccccgtgcctcccgaggacgccacccgtccgagcgacaccgacggcccggaccccgtggggccctcggtcccgtgggtaccgaaacgggacccttaccgttcccccgaacgaacggtaacgttaaccgtcggacggcccggggacgtacgggaccgaaacggggg

SEQ ID NO: 399809 - DNA, 514 bp, Homo sapiens
  misc_feature: GZ8MTXP02IEPYN.19.86.H09.1.454.CMB.2.raw
  modified_base (338)..(338): a, c, t, g, unknown or other
  modified_base (503)..(514): a, c, t, g, unknown or other
tcagtactctcgtgcacgaccggtgctcgatttagtgctatagacttgggtttgggggctgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggccctgaccgattctctggcgagaggtctggcgcctcagcttccctggccatcagaggctccagtctgaagatgagctgattatactgtgcaatntggatgacagtgtgtaacggttccggtttggcggaggacccaaagcgtagaccgtctaagtcacgacccaaaggctcgcccccgtcgtaccacgtctcgttccccaccctccaccacgacgtacgtaaccggtgacgcggcgtacgacgacgacgacgacgacgnnnnnnnnnnnn

SEQ ID NO: 399810 - DNA, 580 bp, Homo sapiens
  misc_feature: GZ8MTXP02FM60A.19.86.H09.1.454.CMB.2.raw
tcagtactctcgtgcacgaccggtgctcgatttagtgctatagacttgggtttgggggaagaggaagactgacggccacactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtggcgcatacgtcgcacagaagtttcagggccgcgtcaccatggccaaggtcgcgtccacgatacagtgtatatggacttgagcagccctgagtctgacgacacggccatgtattagtgtgcgaggcagggacggggacgtaaaggcaagtaaaagtgggttaccgaccccgttgggggacccgaaggggaaccccgtgggtaccacccggtctcccttcacgccctaccacccgaacgggcccacgtccggtcccttccccctcggccgcccctcgcctccgacggcgccacccgtccggacgacgccacgacggccggcccgtcgggg

SEQ ID NO: 399811 - DNA, 567 bp, Homo sapiens
  misc_feature: GZ8MTXP02H5T4V.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcagggccgcgtcaccatggccaaggtcgcgtcacgaatacagtgtatatggacttgagcagcctgagtctgacgacacggcatgtattatgtgcgagcagggacggggactaaaggcaagtaaaagttcggttcgaaccccgtggggacccaggggaaccctgggtccacccgtctccctcgacgccctaccaccaacgggcccaacgtccggtccttcccccgtcggccgccccttggcctccgacggacgccaacccgtccgaagacgcacacgccggcccgtgggcc

SEQ ID NO: 399812 - DNA, 431 bp, Homo sapiens
  misc_feature: GZ8MTXP02GJXGX.19.86.H09.1.454.CMB.2.raw
  modified_base (424)..(431): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccaggggaaccctggtcaccgtctcctcacgcctccaccaaggccccatccggtcttccccctggccgcccctgcctccgaggacgccaccctccgagacgcacagcccggccctgggctgcctggcaggctactccacgagagtactgagcggctggcaaggcgcatagnnnnnnnn

SEQ ID NO: 399813 - DNA, 642 bp, Homo sapiens
  misc_feature: GZ8MTXP02JGN74.19.86.H09.1.454.CMB.2.raw
  modified_base (311)..(311): a, c, t, g, unknown or other
  modified_base (320)..(320): a, c, t, g, unknown or other
  modified_base (358)..(358): a, c, t, g, unknown or other
  modified_base (629)..(631): a, c, t, g, unknown or other
  modified_base (633)..(633): a, c, t, g, unknown or other
  modified_base (635)..(635): a, c, t, g, unknown or other
  modified_base (637)..(638): a, c, t, g, unknown or other
  modified_base (640)..(642): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgtattctcgtggcgaggaggtctggcgcctcagccttccctggccatcagaggctccngtctgaagntgaggctgatttattactgtgctaatctagggatgacnggtgtcggtaaaccggggtttcccgggtttgggacggggtacggggaacctaaaggccttacggacccgttccgtaaaggttccgaacgaccccgtaaaggcccgttcccggcccccccgttcgggttaccctacccgttcccgttcccggtttccccccgtcccccttaccccgttaccccgaaccggtaccggtaacggttacccggtcgggaacggcccgggggtacctcgggggaacccgaaaggggccgaccgtaagtacggcgcnnngncncnncnnn

SEQ ID NO: 399814 - DNA, 577 bp, Homo sapiens
  misc_feature: GZ8MTXP02FR9OW.19.86.H09.1.454.CMB.2.raw
  modified_base (195)..(195): a, c, t, g, unknown or other
  modified_base (302)..(302): a, c, t, g, unknown or other
  modified_base (512)..(512): a, c, t, g, unknown or other
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggctttttggatacaccttcagtcattatcatatactctgggtncgacaggcccctggacaagggcttgagtggatagggcgatccaggtggtagtggtggcgcatacgtcgcacagaagtttcagggccgcgtcaccatggccaaggtcncgtcacgaatacagtgtatatggacttgagcagcctgaggtctagacgacaccggcagtgtattagttgtgcgagggcagggacggggactaaaggactaagtaaaggttcggttaccgaccccggttagggggacccaaacggggaccctaggtaccaccgtctcctcacgcctacccaccgaacgggcccactccggtccttccccgngccgccctcgcctaccgaggcgaccgacctaccggaagacgacacgacgccggtaccgtcggccg

SEQ ID NO: 399815 - DNA, 621 bp, Homo sapiens
  misc_feature: GZ8MTXP02GYIMV.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagttcagggccgcgtcaccagtggccaaggtcgcgtccacgaatacagtgtatatggacttgagcagcctgaggtctagacgacacggccatgtattattcgtgcggagcgagggacggggactaaaggcaagtaaagtggttacccggaccccgtgggggaccgaacggggaaccccgtcggtaccgtaacccgttcgtcccgttccacggacccctacccgaacccgaaacgggccccctagtcccggtcccctttcccccgtcggtcccgtcccctcggccctccgaacgggaccgaccaccccgtacccggaagaccggacaccgacgcccggcccgttcggggcccg

SEQ ID NO: 399816 - DNA, 508 bp, Homo sapiens
  misc_feature: GZ8MTXP02I10L0.19.86.H09.1.454.CMB.2.raw
  modified_base (355)..(355): a, c, t, g, unknown or other
  modified_base (497)..(508): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttcccctggccatcagagggctccagtctgaagatgaggctgatttatactgtgcaatctgggatgacngtgtgaacggtccgtttcggcggtagggaccaagctgaccgtctaagtcagccaaggcctacgcccccgtcggtcactctcgtttccccaccctcctccaccgagacgtactggacgtcgggctggcaagggccgcatacgnnnnnnnnnnnn

SEQ ID NO: 399817 - DNA, 529 bp, Homo sapiens
  misc_feature: GZ8MTXP02J1EXT.19.86.H09.1.454.CMB.2.raw
  modified_base (321)..(321): a, c, t, g, unknown or other
  modified_base (354)..(354): a, c, t, g, unknown or other
  modified_base (519)..(529): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaatcgtcatctataatgacgctgagcggtccttaagggtccctgaccgattctctggcgagaggtctggcgcctcagcttcccctggcccatcagagggctccagtctgaagntgaggctgattatactgtgcatctgggatgacnggtgtacggtaacggttccgggttttcggcgggaggggtaccaagtcctggacccgtccgtaagtcacgcccaaggcctcgcccccgtcggtccactcctcgtccccaccctccctccacgacgtacgtacgtcggacgcgggcgtggccgaaggccgcaagcgnnnnnnnnnnn

SEQ ID NO: 399818 - DNA, 629 bp, Homo sapiens
  misc_feature: GZ8MTXP02JEMMT.19.86.H09.1.454.CMB.2.raw
  modified_base (163)..(163): a, c, t, g, unknown or other
  modified_base (617)..(617): a, c, t, g, unknown or other
  modified_base (619)..(629): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcaagaaacgtcccaggaaccgccccaaatcgtcatctataatgacgctgagcggtaccttaagggccctgaccgtattctcgtggcgagaggtctgggccgcctcacgtccttccccgtggccatcgagagggcctccagtctagaagactggagctagatttatactgtcgactaatcgtaggggatcgacgtggtggtacgggtaaaccggggtttccgggttttacggggacggggtaaacggggaacccgaaagtccgtacggaacccgttaccgtaacggttccgaacggaccccgaaacgggtccctaccggtcccccccgtcgggttaccctaccgttccgttacccgttcccccaacccctcccgtacccgaacgacggtaacgtacgtcggacggccgggcgacggacgaacggcgacgatacgcncnnnnnnnnnnn

SEQ ID NO: 399819 - DNA, 732 bp, Homo sapiens
  misc_feature: GZ8MTXP02I162U.19.86.H09.1.454.CMB.2.raw
  modified_base (225)..(225): a, c, t, g, unknown or other
  modified_base (720)..(720): a, c, t, g, unknown or other
  modified_base (722)..(732): a, c, t, g, unknown or other
tcagtactctcgtgcacgaccggtgctcgatttagtgctatagacttgggtttggggcgttcctggcccgacgtctgtgctgactcaggcaccctcagcgtctgggacccccgggccagacggtcaccatcgcttgttctgcaagcagctcgaacatcgggagcagtggtgtgatgtggtatcaagaaagtcccaggaaccggccccaaactcgtcatctataangacgctgacgcggtacctttaagggccctgaccgattcctcgtggcggagaggtcgtggcgcctcacgtccttccccgtggccactcgagacgggctccagtctgaagagtgaggctgtaagtttacttacgtgtcgactaagtcgtagggtatacggtactaggggttaggtacggggttaaaccggggtttccccgggggtttttacgggggaccgggggtaaacgggggtaaacccgtaaagggtacccggttacggtaaccccggttacccgtaaacggttaccgtaacccggaccccggtaaacggtcccggttccccgtccccccgtaccgggttaccctaacccgtttcccgttcccccgggtttaccccccgtccccccttacccccggttacccccgaaccggtttaacgggacccggtttaacggtccggggaacgggtaccggggtccgtacgggaaccgtaaacggggccgaccgtaaagcgncnnnnnnnnnnn

SEQ ID NO: 399820 - DNA, 567 bp, Homo sapiens
  misc_feature: GZ8MTXP02ISXWZ.19.86.H09.1.454.CMB.2.raw
  modified_base (195)..(195): a, c, t, g, unknown or other
  modified_base (335)..(335): a, c, t, g, unknown or other
  modified_base (347)..(347): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccgaggtggtagtggtggcgcatacgtcgcacagaagttcagggccgcgtcaccatggccaaggtcgcgtccaacgaatacagtgtatatggacttgancagcctgagtcngacgacacggcatgtattatgtgcgagcagggacgggactaaaggcaataaagtggttaccgacccgtggggccacgggaaccctggtccacgtctcctcacgcctaccgaccgaacgggcccacgtccgtccctcccccgtcgcccgccctcgccgtccgacggacgacccgacccgtaccggaacgacgaccgacgacggcccggcccgtcggggccg

SEQ ID NO: 399821 - DNA, 564 bp, Homo sapiens
  misc_feature: GZ8MTXP02IXAKW.19.86.H09.1.454.CMB.2.raw
  modified_base (362)..(362): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgaggtctgacgacacggccntgtattatgtgcgagggcaggggacgggataaaggcagtaaagtggttccgacccgtggggccagggacctggtccaccgtctcctcacgccctccgaccgacgggcccagtccggtccttcccccgtcgccgtccctcgcctccgacggtacgaccgacccgtccgaaggacgccgacgacggccggcccgtcggggtccg

SEQ ID NO: 399822 - DNA, 545 bp, Homo sapiens
  misc_feature: GZ8MTXP02GEXDZ.19.86.H09.1.454.CMB.2.raw
  modified_base (284)..(284): a, c, t, g, unknown or other
  modified_base (335)..(335): a, c, t, g, unknown or other
  modified_base (488)..(488): a, c, t, g, unknown or other
  modified_base (493)..(493): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccncgtcaccatggccaaggtcgcgtccacgaatacagtgtatatggacttgancagctgagtctgacgacacggcagtgtattagtgtgcgaggcagggacgggactaaaggcaagtaaagtggtccgacccgtgggccgacgggacccgtggccaccggtctcctcacgccctcccaccgaacggcccagtccgtccttccccgnggccnccctgcctccgacggcgccaccgtccgaagacgacacgagccgccgtggccg

SEQ ID NO: 399823 - DNA, 536 bp, Homo sapiens
  misc_feature: GZ8MTXP02INML8.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgagtctgacgacacggcatgtattatgtgcgaggcaggacgggctaaagcataaagtggttccgacccgtggggccagggaaccctggccaccgtctcctcacgccctccaccacggcccatccgtctccccgtcggcgccctgcctccgacggcgccgacctccgaagacgacaccacgccggcccgtgggtccg

SEQ ID NO: 399824 - DNA, 498 bp, Homo sapiens
  misc_feature: GZ8MTXP02GS7H5.19.86.H09.1.454.CMB.2.raw
  modified_base (163)..(163): a, c, t, g, unknown or other
  modified_base (261)..(261): a, c, t, g, unknown or other
  modified_base (353)..(353): a, c, t, g, unknown or other
  modified_base (374)..(374): a, c, t, g, unknown or other
  modified_base (483)..(483): a, c, t, g, unknown or other
  modified_base (486)..(498): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaatcgtcatctataatgacgctgagcggtccttaagggtccctgaccgattcnctggcgagaggtctggcgcctcagcttccctggccatcagagggctccagtctgagatgaggctgattatactgtgcaatcgtgggatgacngtgtgtacggtcggtttcggnggagggtacaagctgaccgtcaagtcagcccaagctcgccccctggtcactctcgttccccgccctcctaccacgagacgtacgtgacgcgggctggcaaggccgacanagnnnnnnnnnnnnn

SEQ ID NO: 399825 - DNA, 640 bp, Homo sapiens
  misc_feature: GZ8MTXP02J3KDE.19.86.H09.1.454.CMB.2.raw
  modified_base (198)..(198): a, c, t, g, unknown or other
  modified_base (366)..(366): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagccctggggcctcagtgaaggtctcctgcgaggcttttggatacaccttcagtcattatcatatactcgtgggtncgacaggcccctggacaagggcttgagtggatagggcgatccgacgggttgtagtggtggcgcatacgtcgcacagaagtttcagggccgcgtcaccatcggccaaggtcgccgtccacgaatacagtagtatatggacttgagcagcctgagtctgacgacacggcntgtattcgttgtgcgagggccgagggacggggactaaaggcaagtaaacggttcgggttacccggtaccccgtgggggacccgtaacgggggtaacccccgtggtccctaacccggttcctcccgttccacggcccctaccccgaacccgaaaccggggccccaacggttcccggttcccgtttccccccgtcgggtcccgccccttgcctacccgagggaccgcctaacccgccgaacgcgaccacgacgcccgggtccctacgggggtcccg

SEQ ID NO: 399826 - DNA, 389 bp, Homo sapiens
  misc_feature: GZ8MTXP02IX81X.19.86.H09.1.454.CMB.2.raw
  modified_base (385)..(389): a, c, t, g, unknown or other
tcagtactctcgtgcacgaccggtgctcgatttagtgctatagacttgggtttgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtggtaacggtccggtttcggcggagggaccaagctgaccgtctaagtcagccaaggctcgccccctcggtcactctcgttccccaccctcctccacgagacgtactgacgcggggctggcagggcgcgatagnnnnn

SEQ ID NO: 399827 - DNA, 562 bp, Homo sapiens
  misc_feature: GZ8MTXP02GIEL4.19.86.H09.1.454.CMB.2.raw
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgaggtctgacgacacggccntgtattattgtgcgaggcagggacggggactaaaggcaataaaggtggttccgacccgtgggggccacgggaaccctggtcaccggtctcctcacgcctacccaccgaacgggccccacgtccggtcccttcccccgtcggccgccctcgcctccgaggacgccaccgtccgaaggacgcgacacggccggcccgtcgggtcc

SEQ ID NO: 399828 - DNA, 518 bp, Homo sapiens
  misc_feature: GZ8MTXP02FTZ1G.19.86.H09.1.454.CMB.2.raw
  modified_base (355)..(355): a, c, t, g, unknown or other
  modified_base (411)..(411): a, c, t, g, unknown or other
  modified_base (472)..(472): a, c, t, g, unknown or other
  modified_base (480)..(480): a, c, t, g, unknown or other
  modified_base (507)..(514): a, c, t, g, unknown or other
  modified_base (516)..(518): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcaagaaagtcccaggaaccggcccccaaaactcgtcatctataatgacgctgagcggtccttaagggtccctagaccgattctcgtggcgagaggtctggcgctcagcttccctggccatcagagggctccagtctgaagatgagctgattatactgtgcatcgtggatgacngtgtcgtaacgggtccgttttcggcggagggaccaaagctagacccgtacgtagtnacgcgacgaacggcttcgccccctcggtccacttctcgttcccgccctcctccgaccgagngttaacgngacgcggcgcgacgacgcacacgacgnnnnnnnncnnn

SEQ ID NO: 399829 - DNA, 567 bp, Homo sapiens
  misc_feature: GZ8MTXP02FOQTY.19.86.H09.1.454.CMB.2.raw
  modified_base (191)..(191): a, c, t, g, unknown or other
  modified_base (239)..(239): a, c, t, g, unknown or other
  modified_base (246)..(246): a, c, t, g, unknown or other
  modified_base (271)..(271): a, c, t, g, unknown or other
  modified_base (346)..(346): a, c, t, g, unknown or other
  modified_base (358)..(358): a, c, t, g, unknown or other
  modified_base (371)..(371): a, c, t, g, unknown or other
  modified_base (460)..(460): a, c, t, g, unknown or other
  modified_base (518)..(518): a, c, t, g, unknown or other
tcagtactctcgtgcacgaccggtgctcgatttagtgctatagacttgggtttggggtaagaggaagactgacggcccactcccaggtgcagctggtgcagtctgggctgaggtgaaggagcctgggcctcagtgaaggtctcctgcgaggcttttggatacacctcagtcattatcatatactctgggtncgacagccctggacaggcttgagtggataggcgatccacggtgtagtntggcgcntacgtcgcacagaagttcagggccncgtcaccatggccaaggtcgcgtccacgatacagtgtatatggacttgagcagcctgaggtctgacgacacgccntgtattattgtncgaagcagtacgngggaaacgtagacaagttaattacggttcccgtaccccgggtcacgggggaccccgaacgttcccgtaccgtccttcctcctacgcccncccacccaccgacccgaccgaccgtccgtcccgtcccgtcccgtcccgccgccgtccnccgacgacgaccgaccgaaccgacgacgacgacgacgaccgccgtccgg

SEQ ID NO: 399830 - DNA, 557 bp, Homo sapiens
  misc_feature: GZ8MTXP02I1IX8.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtgtagtggtggcgcatacgtcgcacagaagtttcagggccgcgtcaccatggccaaggtcgcgtccacgaatacagtgtatatggacttgagcagcctgaggtctgacgacaccggccatgtattattgtgcgaggcagggacggggctaaaggacataaaagtggttccgaaccccgtggggaccgagggaacccgtggccaccggtctccctcagccctccaccaagggccccatcggtcctccccgttggccgccctggcctccacggacgacccacctcccgaagcgctaccgacgccggcccgtcgggccg

SEQ ID NO: 399831 - DNA, 770 bp, Homo sapiens
  misc_feature: GZ8MTXP02IQ1DY.19.86.H09.1.454.CMB.2.raw
tcagtactctcgtgcacgaccggtgctcgatttagtgctatagactttgggtttgggggaagaggaagactgacggccccactcccaggtgcagctggtgcagtctggggctgaggtgaaggagcctggggcctcagtgaaggtctcctgcgaggtcttttggatacaccttcagtcattatcatatactcgtgggtgcgacgacggcccctaggacgaagggtcttgagtggagtagggcgatccgaggtggtagtggtggcgcatacgtcgacacagaagtttcgagggccgcgtcaccagtcggaccaaggtccgcgtccaacgaatacgagtgtatagtggtacttgagcacgcctgaggtctagacgacaccggaccagttagttaatttattgtacggcgagggacgaaggggacggggacgtaaaaggacgaaagttaaaaggttcggttaccggaccccgtacgggggacccgaacggggtaaaccccgttcgggtacccgtaacccggttccgttacccgtaccgtaaccggtcccccgtacccgaaaccccggaaaccgggggtaccccctaaaccggttccccgggtttacccccgtttccccccggtacccgggtaccccctaccccccgtttacccccgttaaccccgtaaaaccggacccgtaccccgtaaccccggttccggggtaccgggggaaccctaaaccggacccgggccccggtaccccggtcggggtcccgttccgggtaacccccgg

SEQ ID NO: 399832 - DNA, 609 bp, Homo sapiens
  misc_feature: GZ8MTXP02IJLK9.19.86.H09.1.454.CMB.2.raw
  modified_base (339)..(339): a, c, t, g, unknown or other
  modified_base (363)..(363): a, c, t, g, unknown or other
  modified_base (374)..(374): a, c, t, g, unknown or other
tcagtactctcgtgcacgaccggtgctcgatttagtgctatagacttgggtttggggggaagaggaagactgacggcccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtgtagtggtggcgcatacgtcgcacagtaagttcagggccgcgtcaccagtcggaccaaggtcgcgtaccagaatacagtgtatagtggacttgancagctgaggtcagacgacacggcntgtattattgngcgaggcgaggggacgggataaaggctaaagtaaaggttcggttacccgacccggtgggggacccgaaggggacccctgggtaccctacccggtccttcccgtacgaccggtacccctacccgaacgaaccggggccctaacggttcccggttcccgtcccccgtcggccctcccgtcggaccctcggaacgcgaccctccgtacgaagacgcacgcggccggtcccgtgggccg

SEQ ID NO: 399833 - DNA, 563 bp, Homo sapiens
  misc_feature: GZ8MTXP02G9CHI.19.86.H09.1.454.CMB.2.raw
  modified_base (321)..(321): a, c, t, g, unknown or other
  modified_base (500)..(500): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagtttcgagggccgcgtcaccatcggccaaggtcgcgtccacgaatacagtntatatggacttgagcagcctggagtctgacgacacggccagtgttattagttgtgcggagcgagggacggggactaaaggcaagtaaagtggttaccgacccgtcggggccacggggaaccgtggtccaccgtctccgtcgacgcctaccgaccgacggcccagtccgtccttccccgngccgccctcgcctccgacggcgccacccgtccgaacgcgaccacgcggccggccgtcgggccg

SEQ ID NO: 399834 - DNA, 624 bp, Homo sapiens
  misc_feature: GZ8MTXP02H0FU8.19.86.H09.1.454.CMB.2.raw
  modified_base (285)..(285): a, c, t, g, unknown or other
  modified_base (319)..(319): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtgggtggcgcatacgtcgcacagaagtttcagggccncgtcaccatggccaaggtcgcgtccacgaataanacgtgtatataggtacgttagtagacgacgccgtcgtaggtcgttcgacggacgaccggccgactagttatttaactttagtgtcggaggacggacggacgggggacggtaaagaacgaataaagttaggtcggtacccgaccggggtccggacggaaccggtaccgtcgaccgtaccgtcctcctacgcctacccaccgaacggacccgcgtaccgtccgtcccccgtccggtccgcccgtccgtctccgacggtacgccgtaccgccgaacgacgaccgaccgacgccggcccgtcggtccgg

SEQ ID NO: 399835 - DNA, 493 bp, Homo sapiens
  misc_feature: GZ8MTXP02FZ1W6.19.86.H09.1.454.CMB.2.raw
  modified_base (257)..(257): a, c, t, g, unknown or other
  modified_base (316)..(316): a, c, t, g, unknown or other
  modified_base (353)..(353): a, c, t, g, unknown or other
  modified_base (469)..(469): a, c, t, g, unknown or other
  modified_base (477)..(477): a, c, t, g, unknown or other
  modified_base (484)..(493): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctatatgacgctgagcggtccttaagggccctgaccgattcncgtggcgagaggtctggcgcctcagcttccctggccatcagagggctccagtctgaagntgagctgattattactgtcgctaatctggggatgacngtgtgaacggttcggtttcggcgggagggaccaagctgaccgtctaagtcagcccaagctcgccccctcggcactctcgtccccaccctcctccacgagtacgtactgagcggtcnggcaaggncatacgnnnnnnnnnn

SEQ ID NO: 399836 - DNA, 654 bp, Homo sapiens
  misc_feature: GZ8MTXP02FYGDA.19.86.H09.1.454.CMB.2.raw
  modified_base (308)..(308): a, c, t, g, unknown or other
  modified_base (643)..(645): a, c, t, g, unknown or other
  modified_base (647)..(650): a, c, t, g, unknown or other
  modified_base (652)..(654): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtgtatcagaagtcccaggaaccgccccaaatcgtcatctataatgacgctggagccggttaccttaagggtcccctgacccgtattccgtcgtggacgaggaggtctggccgcctcgacgtcctttccccgnggacccagtccgaaggacgggtcctcccgaagttccgtaggaaagatggacggtcttagtatttagttacgtgtcgactaagtcgtagggatgacgtggtgtacggtaaccgggtttccgggtttcgggacgggaacgggtaccgaagtccgttaccggacccgttaccgtaacggtccgaacggccccgtaaacgggcccttcccggaccccccgttgggttaccctaccgttccgttaccccgttccccctaaccccctttccgacccgtacgacgtacgtacgtacggacggccgggtactacgggaccgaacggtcgacgtagtacgcgcnnngnnnncnnn

SEQ ID NO: 399837 - DNA, 648 bp, Homo sapiens
  misc_feature: GZ8MTXP02GZYC7.19.86.H09.1.454.CMB.2.raw
  modified_base (163)..(163): a, c, t, g, unknown or other
  modified_base (270)..(270): a, c, t, g, unknown or other
  modified_base (635)..(637): a, c, t, g, unknown or other
  modified_base (639)..(639): a, c, t, g, unknown or other
  modified_base (641)..(641): a, c, t, g, unknown or other
  modified_base (643)..(644): a, c, t, g, unknown or other
  modified_base (646)..(648): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaatcgtcatctataatgacgctgagcggtaccttaagggtccctgaccgtattctcgtggacgngaggtctggcgcctcacgcttccctggccatcagacgggcctccgagtctaggaagtagtggaacgggtcttaggaattttagtaaccgttgtacggtactaaagttccgtaggggtataggtacgtagggttaggttacgggtaaaccggggtttcccggggtttttacggggacggggtaacggggtacccgaaacgtcgtacggtacccgtaccgtaagtcgacgcgacaagggcctccgcccccgtggtcctaccttcgtccgttcccctacccctaccgtacccgacgacgtacgttaacgcgggaaccgggtcggggtaccgttcgggaccggaaacggtccggtaaccagtacggcgnnngncncnncnnn

SEQ ID NO: 399838 - DNA, 557 bp, Homo sapiens
  misc_feature: GZ8MTXP02FZNCL.19.86.H09.1.454.CMB.2.raw
  modified_base (286)..(286): a, c, t, g, unknown or other
  modified_base (347)..(347): a, c, t, g, unknown or other
  modified_base (515)..(515): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgngtcaccatggccaaggtcgcgtccacgaatacagtgtatatggacttgagcagcatgagtntgacacacggcatgtaattatgtgcgaggcgaggacgggactaaaggcaagtaaagtcggtacgacccgtgggccgagggaacccgtggtccaccgtctcctcagccctacgaccacgggccagtccggtccttccccgtggcccgcccgtcgccgtaccgacggacnccgacccgaacgacgacgccgacgacggcccggccgtcgggg

SEQ ID NO: 399839 - DNA, 557 bp, Homo sapiens
  misc_feature: GZ8MTXP02HQ5HM.19.86.H09.1.454.CMB.2.raw
  modified_base (195)..(195): a, c, t, g, unknown or other
  modified_base (351)..(351): a, c, t, g, unknown or other
  modified_base (357)..(357): a, c, t, g, unknown or other
  modified_base (361)..(361): a, c, t, g, unknown or other
  modified_base (533)..(533): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtcgcacagaagtttcagggccgcgtcaccatggccaaggtcgcgtccagaatacagtgtatagtggacttgagcagcctgaggtctgacgnacggcntgtnttagttgtgcgagcaggacgggactaaaggcagtaaagtcggttacgacccgtcggggccacgggaccctggaccgtacccgtcgtccgtctacggcccaccgaaccgacgggcccacggtccgtcctccccgtgccgcccttggcctcgacggacgcaccctcgaacgacnccgacgcggcccgccgtcgggccg

SEQ ID NO: 399840 - DNA, 569 bp, Homo sapiens
  misc_feature: GZ8MTXP02J1BV6.19.86.H09.1.454.CMB.2.raw
  modified_base (196)..(196): a, c, t, g, unknown or other
  modified_base (361)..(361): a, c, t, g, unknown or other
  modified_base (373)..(373): a, c, t, g, unknown or other
  modified_base (375)..(375): a, c, t, g, unknown or other
  modified_base (501)..(501): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagtttcgagggccgcgtcaccatggccaaggtcgcgtccacgaatacagtgtatatggacttgagcagcctgagtctagacgacacggcngtgtattagtgngngagcgagggacgggataaagctaagtaaagtcggtaccgacccggtggggaccgacgggacccgtggtccaccgtctcctcaccgcctccaccgacggcccagtccggtccctccccgcggtcccnccctcgcctaccgacggcgacccgtacccgaccggaagacgacacgaccggcccggtccgcggtcccg

SEQ ID NO: 399841 - DNA, 487 bp, Homo sapiens
  misc_feature: GZ8MTXP02GABYK.19.86.H09.1.454.CMB.2.raw
  modified_base (352)..(352): a, c, t, g, unknown or other
  modified_base (437)..(437): a, c, t, g, unknown or other
  modified_base (457)..(457): a, c, t, g, unknown or other
  modified_base (459)..(459): a, c, t, g, unknown or other
  modified_base (465)..(465): a, c, t, g, unknown or other
  modified_base (475)..(475): a, c, t, g, unknown or other
  modified_base (478)..(487): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacngtgtgaacggtccgttttggcggagggaccaagctgaccgtctaagtcagcccaaggctgccccctcggtcacctctcggtcccnccctcctccacgagagtacngngcggcngcgagcgcanagnnnnnnnnnn

SEQ ID NO: 399842 - DNA, 569 bp, Homo sapiens
  misc_feature: GZ8MTXP02GVUAK.19.86.H09.1.454.CMB.2.raw
  modified_base (459)..(459): a, c, t, g, unknown or other
  modified_base (466)..(466): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcaggggccgcgtacaccagtcggccaaggtcgcgtccacgaatacagtgtatatggacttgagcagcctgagtctgacgacacggcagtgtattattgtgcgaggcagggacgggagtaaaggacaagtaaagtacggttaccgacccgtggggaccgacgggaaccctcgggtcaccgtctccncacgccnccgaccacggcccagtccgtcctcccccgtggccgccctcgcctaccgacggacgccaaccgtccggaacgacgaccgacgacggccggacccgtggggtccg

SEQ ID NO: 399843 - DNA, 580 bp, Homo sapiens
  misc_feature: GZ8MTXP02HZUS6.19.86.H09.1.454.CMB.2.raw
  modified_base (361)..(361): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggctttttggatacaccttcagtcattatcatatactctgggtgcgacaggcccctggacaagggcttgagtggatagggcgatccgaggtgtagtggtggcgcatacgtcgcacagaagtttcagggccgcgtcacatggccaaggtcgcgtccacgaatacagtgtatatggtacttgagcagcctgaggtctgacgacacggccntgtattattgtgcgaggcgagggacggggactaaaggcaagtaaaagttcggttaccgaacccgtcgggggccgacgggaccctgggtccaccgtctccgtccagccctccaccgaacgggcccagtcccggtccttcccccgtggccgccctcggacctcccgacggacgaccaccctaccggaacgacgacgaccgagcccgggccctcggggcccg

SEQ ID NO: 399844 - DNA, 601 bp, Homo sapiens
  misc_feature: GZ8MTXP02JBT6L.19.86.H09.1.454.CMB.2.raw
  modified_base (368)..(368): a, c, t, g, unknown or other
  modified_base (382)..(382): a, c, t, g, unknown or other
  modified_base (473)..(473): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcgagggccgcgtcaccatcggaccaagggtcgcgtccacgaatacagtgtaatagtggacttgagcagcctgaggtctagacgacacggccngttgtattagttgngtacggaggcgaggggacgggacgtaaaggcaaagtaaagtcggtaccgacccggtggggaccgacgggaccctgggtccaccggtctccncgacgccctccgaccgaacggccctagtcccggtccctcccccgcggcccgtcccgtcgcctaccgacgggaccgaccgaccctccggaacgaccgaccgaccgacggcccggcccgttcgggtcccg

SEQ ID NO: 399845 - DNA, 600 bp, Homo sapiens
  misc_feature: GZ8MTXP02HGG4O.19.86.H09.1.454.CMB.2.raw
  modified_base (339)..(339): a, c, t, g, unknown or other
tcagtactctcgtgcacgaccggtgctcgatttagtgctatagacttgggtttgggggaagaggaagactgacggccccactcccaggtgcatctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccgcgtcaccatggccaaggtcgcgtccagaatacagtgtatatggacttgagcagccngaggtctgacgacacggcagtgtattattgtgcggaggcgaggggacgggactaaaggcaaagtaaaggtcgggttaccgaccccggttgggggacccaacggggaaccccttgggtcctacccggtcctcccgtcacgcccctacccaaccgaacgggcccctacgttccggtccctttcccccgcggcccgccccgtgccctccgacggcgaccacccgtaccgaacggacgaccacgacggccggcccgtgggtcccg

SEQ ID NO: 399846 - DNA, 506 bp, Homo sapiens
  misc_feature: GZ8MTXP02J2LM2.19.86.H09.1.454.CMB.2.raw
  modified_base (163)..(163): a, c, t, g, unknown or other
  modified_base (317)..(317): a, c, t, g, unknown or other
  modified_base (351)..(351): a, c, t, g, unknown or other
  modified_base (491)..(491): a, c, t, g, unknown or other
  modified_base (495)..(506): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccgccccaaactcgtcatctataatgacgctgagcggtccttaagggccctgaccgattctctggcgagaggtctggcgcctcagcttccctggccatcagagggctccagtctgaagntgaggctgattatactgtgcaatctgggatgacngtgtagtacggtccggtttggcggaggacccaagctgaccgtcctacgtcacgcccaaggcctcgccccctcggtaccactctcgttccccaccctcctaccacgacgagtactggacgcggcgtggcaaaggcgacganagcnnnnnnnnnnnn

SEQ ID NO: 399847 - DNA, 608 bp, Homo sapiens
  misc_feature: GZ8MTXP02J24G0.19.86.H09.1.454.CMB.2.raw
  modified_base (198)..(198): a, c, t, g, unknown or other
  modified_base (349)..(349): a, c, t, g, unknown or other
  modified_base (367)..(367): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagccctggggccctcagtgaaggtctcctgcgaggcttttggatacaccttcagtcattatcatatactctgggtncgacaggcccctggacaagggcttgagtggatagggcggatccacggtggtagtggtggcgcatacgtcgcacagaagtttcagggcccgcgtcaccatggccaaggtcgcgtcccacgaatacagtgtatatggactttgagcagcctgnggtctgacgacacggccntgtattatttttgcgaggcgagggacgggggctaaaagggacagtaaagtagggtttacgacccccggttgggggacccggacgggaaacccccgttcgggtccacccgttcctccttccacggccctcccaccccgaaacgggaccccatcccggtcctttcccccccgttcggcccggtcccctcgcctcccacgggacgaccaccctccgagaacgcacacgcgcccgtcggcgtcgg

SEQ ID NO: 399848 - DNA, 563 bp, Homo sapiens
  misc_feature: GZ8MTXP02H7N7M.19.86.H09.1.454.CMB.2.raw
  modified_base (360)..(360): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccgcgtcaccatggccaaggtcgcgtccacgaatacagtgtatatggacttgagcagcctgaggtctgacgacacggccntgttattattgtgcgaggcagggacgggctaaaggcaagtaaagttggttccgaccccgtggggaccgacgggaaccctggtcacccgtctcctcacgcctccgaccgacgggcccacgtccggtcctcccccgtggcccgccctcgcctccgacggacgccgaccctccggaagacgccacgacggccggccgtcgggcccg

SEQ ID NO: 399849 - DNA, 588 bp, Homo sapiens
  misc_feature: GZ8MTXP02IHW58.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtggcgcatacgtcgcacagaagtttcagggccgcgtcaccatggccaaggtcgcgtccacgaatacagtgtatatggacttgagcagcctgagtctgacgacacggccatgtattattgtgcgaggcagggacgggactaaaggcaagtaaagtggttaccgacccgtggggaccacgggaccctggtaccaccgtcctcccgtcacggccctcccgaccgaacgggcccctaacgtccgggttcccttcccccgtcggcccgtcccgtcggccttcccgaaacggcgacccaccctaccggaacgaacgccaccgacggccggcccgttagggcccg

SEQ ID NO: 399850 - DNA, 597 bp, Homo sapiens
  misc_feature: GZ8MTXP02JQNQD.19.86.H09.1.454.CMB.2.raw
  modified_base (303)..(303): a, c, t, g, unknown or other
  modified_base (370)..(370): a, c, t, g, unknown or other
  modified_base (548)..(548): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacagggcttgagtggatagggcgatccgaggtggtagtggtggcgcatacgtcgcacagagttcagggccgcgtcaccagtcggccaaggtcncgtccacgaatacagtgtatatggacttgagcagcctgagtctgacgacacggcagtgtattattgngcgaggcgaggggacgggataaaggcaagtaaaggtggtaccgaccccggtaggggcccgacggggaacccgtggtaccaccggttcctcccgtacgacgccctaccgacccgaaacggggccccagttcccggtcccttcccccgtcggcccgcccctcgccgtccgacgggacccncccgtacccgcgaacgacgaccgacgaccggcccggcccggtcggtccg

SEQ ID NO: 399851 - DNA, 608 bp, Homo sapiens
  misc_feature: GZ8MTXP02J3VE0.19.86.H09.1.454.CMB.2.raw
  modified_base (259)..(259): a, c, t, g, unknown or other
  modified_base (379)..(379): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacaggcccctggacaagggcttgagtggatagggcgatccgagggtggtaggtggtggcncatacgtcgcacagtaagttcgacgggccgcgtcacgagtcggaccaaggtcgccgtccaacgaatactagtgtatagtgtactgagtcagcctggacgtcacgacgacgacggctagtnttaatttagtgtgcgaggcgaggggacgggacgtaaaggactaagtaagtcggtaccgacccggtggggacccgacggaccgtcggtccacccgtctcctcacgtccctaccgaccgaacggccccgtacgtcccgttcccttcccccggcggtccccgaccctcgcccgtaccgacggccgacccgaccgtccggaacgacgcaccgtcggcccggccgtcgggcccg

SEQ ID NO: 399852 - DNA, 646 bp, Homo sapiens
  misc_feature: GZ8MTXP02JK8M2.19.86.H09.1.454.CMB.2.raw
  modified_base (352)..(352): a, c, t, g, unknown or other
  modified_base (381)..(381): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagttcgacgggccgcgtcaccagtcggacccaaggtcgcgtccagaatacagtgtatagtggacttgagcagcctgacgtcngaccgacaccggctagtgtaattagttgngcggagggcgaggggacggggtacgtaaaaggcaaagttaaaggttcggttaccgaaccccggtcgggggacccgaacggggtaaccccgtcggtacccgtaccggttcccttcccgtcccgaacggtccccctaccgaacccgaaacgggccccgtaacgttccgggtccccctttcccccgcgggcccgtccccgttcgccgtacccgaacgggccgacctacccgtcgaagaccgacaacgccggccggccccgtggtcccg

SEQ ID NO: 399853 - DNA, 661 bp, Homo sapiens
  misc_feature: GZ8MTXP02HIRRK.19.86.H09.1.454.CMB.2.raw
  modified_base (195)..(195): a, c, t, g, unknown or other
  modified_base (223)..(223): a, c, t, g, unknown or other
  modified_base (231)..(231): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgggnggagaggnggagtcacggtgggtaggtggtggcgcatacgtcgcacagaagttacgtacggccggcgtcacactggcaacggtacgccgtccgtacgaataactagtagtagtaataggtacgtttagagacgagaccgtcgaggtacttcgacgaacacggaccgactgttagtttaattgttcgaggacgggacacggggaacggggaccgttaaaagaagacgtaaaaggttacgggttccggtaaaccccggtcgggggacggaaccggtacccgtacggtacgacccgtaccttccgtacaacgccgtacccaccgaaaccggacccgacttcggtcccttcccccgtcggccggccctcggtctacccaacggacgacccgccctaaccgacggaacgcgaaccacggcccgttcccggacggcgtacccgg

SEQ ID NO: 399854 - DNA, 557 bp, Homo sapiens
  misc_feature: GZ8MTXP02G4766.19.86.H09.1.454.CMB.2.raw
  modified_base (365)..(365): a, c, t, g, unknown or other
  modified_base (377)..(377): a, c, t, g, unknown or other
  modified_base (388)..(388): a, c, t, g, unknown or other
  modified_base (461)..(461): a, c, t, g, unknown or other
  modified_base (505)..(505): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgacggtggtagtggtggcgcagtacgtcgcacgagtaagtttcgagggccgcgtccaccgagtcggaccaaggtccgcgtccgaacgaatacgagtgtatagtggtacttggagcagcctggagtcngacgacacggcntgtattagtgngcgaggcgaggcgggataaaggcaagtaagtggtccgacccgtggggaccgacggaccgtgccaccgtctccncacgccctccacgacggccacgtccgtccctcccgtgccgcccngcctacgacggtacgccacccgcgaagacgacacgcggtccgcccgtggccg

SEQ ID NO: 399855 - DNA, 476 bp, Homo sapiens
  misc_feature: GZ8MTXP02IDIUD.19.86.H09.1.454.CMB.2.raw
  modified_base (164)..(164): a, c, t, g, unknown or other
  modified_base (215)..(215): a, c, t, g, unknown or other
  modified_base (261)..(261): a, c, t, g, unknown or other
  modified_base (271)..(271): a, c, t, g, unknown or other
  modified_base (275)..(275): a, c, t, g, unknown or other
  modified_base (279)..(279): a, c, t, g, unknown or other
  modified_base (282)..(284): a, c, t, g, unknown or other
  modified_base (289)..(289): a, c, t, g, unknown or other
  modified_base (293)..(294): a, c, t, g, unknown or other
  modified_base (297)..(297): a, c, t, g, unknown or other
  modified_base (301)..(301): a, c, t, g, unknown or other
  modified_base (305)..(305): a, c, t, g, unknown or other
  modified_base (309)..(309): a, c, t, g, unknown or other
  modified_base (311)..(311): a, c, t, g, unknown or other
  modified_base (315)..(315): a, c, t, g, unknown or other
  modified_base (317)..(317): a, c, t, g, unknown or other
  modified_base (325)..(325): a, c, t, g, unknown or other
  modified_base (327)..(327): a, c, t, g, unknown or other
  modified_base (329)..(329): a, c, t, g, unknown or other
  modified_base (332)..(332): a, c, t, g, unknown or other
  modified_base (338)..(338): a, c, t, g, unknown or other
  modified_base (340)..(340): a, c, t, g, unknown or other
  modified_base (375)..(375): a, c, t, g, unknown or other
  modified_base (403)..(403): a, c, t, g, unknown or other
  modified_base (441)..(441): a, c, t, g, unknown or other
  modified_base (463)..(463): a, c, t, g, unknown or other
  modified_base (465)..(476): a, c, t, g, unknown or other
tcagtactctcgtgcacgaccggtgctcgatttagtgctatagacttgggtttgggggccgttcctgggcccagtctgtgctgactcaggcaccctcagcgtctgggaccccccgggcagacggtcaccatcgcttgttctgcaagcagctcgaacatcgggancagtggtgtgatgtggtatcagaaagtcccaggaacggcccccaaatcgtnatctaataatgacgctgagcggtcttaagggtccctgaccgattcnctggcaaggngtcnggcnccnnnctccngcannagnggcncatngaanangagntnattatatntnanatntggatnangtgtgtacggttcggtttcggcggaggacgagcgngacgtactaatcacgacacgctcgcccncgtcactctctcccaccctcctaccacgagacgtacgngagcggcgcgacgacgcgacanannnnnnnnnnnn

SEQ ID NO: 399856 - DNA, 597 bp, Homo sapiens
  misc_feature: GZ8MTXP02G4BGB.19.86.H09.1.454.CMB.2.raw
  modified_base (305)..(305): a, c, t, g, unknown or other
  modified_base (357)..(357): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggccctggacaagggcttgagtggatagggcgatccgaggtggtagtggtggcgcatacgtcgcacagaagttcagggccgcgtcaccagtcggaccaaggtcncgtccaacgaatacagtgtatagtggacttggacgcagcctaggacggttcngacgacacggccagttgtattagtgtgcggagcgagggacgggataaaggcaagtaaaggtggttcccgaaccccgtggggacccacggggaccctgggaccctaccgtcctcctcacggtccctaccgaaccgaacgggcccctaagttcccggtcccttccccgcggtaccgccccgtcgcctaccgacggaacgcccaccgtaccgaacgacgccgacgacggccggccgtcggccg

SEQ ID NO: 399857 - DNA, 609 bp, Homo sapiens
  misc_feature: GZ8MTXP02F0OCJ.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagagttcagggccgcgtcaccatcggaccaaggtcgcgtccacgaatacgagtgtatagtggacttgagcacgcctgaggtctgacgacacggccagtgtatttagttgtgacgagggcgaaggggacggggactaaaggcaagtaaagtcggtccgaccccgtggggcccgaagggaacccgttggtacccaccgtcctcccgtacgaccgtccctacccgaaccgaaccggccctacgtccggttccctcccccgtggcccgtccctcggcctaccggacggaccgacccaacccgtccgaacggaccgacgaccgacggcccggcccgtcgggaccg

SEQ ID NO: 399858 - DNA, 557 bp, Homo sapiens
  misc_feature: GZ8MTXP02H2H87.19.86.H09.1.454.CMB.2.raw
  modified_base (360)..(360): a, c, t, g, unknown or other
tcagtactctcgtgcacgaccggtgctcgatttagtgctatagacttgggtttgggggaagaggaagactgacggcccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccaggtggtagtggtggcgcatacgtcgcacagaagtttcagggccgcgtcaccatggccaaggtcgcgtccacgaatacagtgtatatggacttgagcagcctgaggtctgacgacacggcntgtattagttgtgcgaggcagggacggggactaaaggcaagtaaagtggttcgaccccgtgggccacgggacctggtccaccgtctcctcagccctccgaccaacggcccatccggtctcccccgtcggcccgccctcgcctccgacggacgccacccgtccggaacgacgaccacgacgccggcccgtcgggcccg

SEQ ID NO: 399859 - DNA, 506 bp, Homo sapiens
  misc_feature: GZ8MTXP02F3YIM.19.86.H09.1.454.CMB.2.raw
  modified_base (163)..(163): a, c, t, g, unknown or other
  modified_base (353)..(353): a, c, t, g, unknown or other
  modified_base (493)..(493): a, c, t, g, unknown or other
  modified_base (495)..(497): a, c, t, g, unknown or other
  modified_base (499)..(506): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaatcgtcatctataatgacgctgagcggtccttaagggccctgaccgattctctggcgagaggtctggcgcctcagcttccctggccatcagagggctccagtctgaagatgaggctgattattactgtgcaatctgggatgacngtgtgaacgggttccggtttggcggagggacaagctgaccgtcaagtcagcccaagctcgcccctgccactctcgttccccgccctcctccacgagtacgtacgtggacggccgggactcggacgaaggcggacagacgncnnngnnnnnnnn

SEQ ID NO: 399860 - DNA, 582 bp, Homo sapiens
  misc_feature: GZ8MTXP02F79QH.19.86.H09.1.454.CMB.2.raw
  modified_base (320)..(320): a, c, t, g, unknown or other
  modified_base (359)..(359): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgagggtggtagtggtggcgcatacgtcgcacagaagttcagggccgcgtcaccatggccaaggtcgcgtccacgaatacagtntatatggacttgagcagcctgaggtctgacgacacggcntgtattattgtgcgagggcaggggacggggactaaaggcaagtaaagtcggttaccggaccccgtagggggcccgacgggaaccctgggtaccaccggtctccctcacgccctcccaccgaacggcccacgtccggtcccgttcccccgtcggcccgtcccctcggcctccgacggacgacccacccgtccgaacgcgaccacgacgccggcccgtcggggcc

SEQ ID NO: 399861 - DNA, 591 bp, Homo sapiens
  misc_feature: GZ8MTXP02IW4M0.19.86.H09.1.454.CMB.2.raw
tcagtactctcgtgcacgaccggtgctcgatttagtgctatagacttgggtttggggggaagaggaagactgacggccccactcccaggtgcagctgatgcagtctggggctgaggtgaaggagcctggggcctcagtgaaggtctcctgcgaggcttttggatacaccttcagtcattatcatatactctgggtgcgacacggcccctggacaagggcttgagtggatagggcgatccgacggtggtagtggtggcgcatacgtcgcacagaagtttcagggccgcgtcaccatcggccaaggtcgcgtccacgaatacagtgtatatggacttgagcagcccctgagtctgacgacacggcatgtattatgtgacgaggcgagggacggggactaaagggcaagttaaaggtcgggttacgaccccgtggggaccgacgggaaccctgggtccaccgtcctcctcgacgcctccaaccgacgggcccacgttccggtccctttcccccgtcggcccgtccccgtcggtcctccgacgggaccgccctacccgtccgaacgcgaccgaccgacggcccggcccgtcgggg

SEQ ID NO: 399862 - DNA, 614 bp, Homo sapiens
  misc_feature: GZ8MTXP02H3NJ9.19.86.H09.1.454.CMB.2.raw
  modified_base (320)..(320): a, c, t, g, unknown or other
  modified_base (363)..(363): a, c, t, g, unknown or other
tcagtactctcgtgcacgaccggtgctcgatttagtgctatagacttgggtttgggggaagaggaagactgacggcccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggcccaaggtcgcgtccacgaatacngtgtatatggacttgagcagcctgaggtctgacgacacggccntgtattagttgtgcgagggcagggacggggactaaaggcaagtaaagtggttccgacccgtggggccacgggaccctgggtccaccgtctcctcacgccctacccgaccgtaacggggcccctaagtcccgggttcccttcccccgtcgggtcccgcccccgttcggcccgttacccgacgggaccgacccgtaccccgtacccggaaggaaccgccaaccggacggccccgggccccggttcggggcccg

SEQ ID NO: 399863 - DNA, 567 bp, Homo sapiens
  misc_feature: GZ8MTXP02F74XI.19.86.H09.1.454.CMB.2.raw
  modified_base (559)..(559): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcacccatggccaaggtcgcgtccacgaatacagtgtatatggacttgagcagcctgagtctgacgacacggccatgtaattagttgtgcgaggcagggacggggactaaaggcaagtaaagtggttaccgaccccgtggggccgaggggaccctggtccaccgtctcctcacgccctccgaccgacgggccctacgtccggtccttcccccgtgcccgcccgtcgcctccgacggacgccaccgtccgaagacgacgacacgccggtcccncgggtccg

SEQ ID NO: 399864 - DNA, 502 bp, Homo sapiens
  misc_feature: GZ8MTXP02JVFQW.19.86.H09.1.454.CMB.2.raw
  modified_base (336)..(336): a, c, t, g, unknown or other
  modified_base (444)..(444): a, c, t, g, unknown or other
  modified_base (494)..(502): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcacccaaactcgtcatctataatgacgctgagcggtccttaagggtccctgaccgattctctggcgagaggtctggcgcctcagcttccctggcccatcagaggctccagtctgaagatgaggctgattattacngtgcaatctgggatgcagtgtgaacggtcggtttcggcggtagggaccaagctgaccgtctaagtcacgcccaaggcctcgccccctaggtccactcctcgttccccnccctcctccacgagtacgtactggagcgggctcggcgaaggcgcaatcgnnnnnnnnn

SEQ ID NO: 399865 - DNA, 566 bp, Homo sapiens
  misc_feature: GZ8MTXP02JO0J3.19.86.H09.1.454.CMB.2.raw
  modified_base (362)..(362): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtagtggtggcgcatacgtcgcacagaagtttcagggccgcgtcaccatggccaaggtcgcgtccacgaatacagtgtatatggacttgagcagcctgagtctgacgacacggccntgtattagttgtgcggaggcgagggacggggactaaaggcagtaaagtggttccgacccgtggggccacgggaccgtggtccaccggtctcctcacgccctccaccgacgggcccagtccggtcccttccccgcggccgtcccgtgacctcccgacggacggcctacccgtccgaagacgacacgacgccggcccgtgggcccg

SEQ ID NO: 399866 - DNA, 552 bp, Homo sapiens
  misc_feature: GZ8MTXP02FQF9G.19.86.H09.1.454.CMB.2.raw
  modified_base (347)..(347): a, c, t, g, unknown or other
  modified_base (510)..(510): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgagtcngacgacacggccatgtattattgtgcgaggcagggacggggctaaaggcataaagtggtcgacccgtggggccagggacctggtccaccgtctcctcacgcctaccgaccaacggggccccagtccggtcctcccccgtggccgcccttgcctccgacggacnccgaccgtccgaagcgcaccgcggccggcccgtggggtcccg

SEQ ID NO: 399867 - DNA, 562 bp, Homo sapiens
  misc_feature: GZ8MTXP02IXKRZ.19.86.H09.1.454.CMB.2.raw
  modified_base (339)..(339): a, c, t, g, unknown or other
  modified_base (363)..(363): a, c, t, g, unknown or other
  modified_base (504)..(504): a, c, t, g, unknown or other
  modified_base (545)..(545): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggcccgcgtcaccatcggccaaggtcgcgtccaacgaatacagtgtatagtggacttgancagcctgagtctgacgacacggcngtgtattattgtgcgaggcgaggggacgggactaaagggcaagtaaagtggttcccgacccgtggggaccacgggacctggtccaccgtctcctcagccctacccacgaacggcccagtccggttcctcccccgtggcccnccgtcgcctaccgacggacgccacccgtcgaagacgcaacncggccggccgtgggccg

SEQ ID NO: 399868 - DNA, 584 bp, Homo sapiens
  misc_feature: GZ8MTXP02GMPZG.19.86.H09.1.454.CMB.2.raw
  modified_base (116)..(116): a, c, t, g, unknown or other
  modified_base (162)..(162): a, c, t, g, unknown or other
  modified_base (258)..(258): a, c, t, g, unknown or other
  modified_base (289)..(289): a, c, t, g, unknown or other
  modified_base (317)..(317): a, c, t, g, unknown or other
  modified_base (339)..(339): a, c, t, g, unknown or other
  modified_base (565)..(565): a, c, t, g, unknown or other
  modified_base (567)..(567): a, c, t, g, unknown or other
  modified_base (569)..(569): a, c, t, g, unknown or other
  modified_base (571)..(571): a, c, t, g, unknown or other
  modified_base (578)..(578): a, c, t, g, unknown or other
  modified_base (580)..(580): a, c, t, g, unknown or other
  modified_base (583)..(583): a, c, t, g, unknown or other
tcagtactctcgtgcacgaccggtgctcgatttagtgctatagacttgggtttgggggccgttcctgggcccagtctgtgctgactcaggcaccctcagcgtctgggacccccggnagacggtcaccatcgcttgttctgcaagcagctcgaacatcgggancagtggtgtgatgtggtatcagaaagtcccaggaaccgccccaaatcgtcatctataatgacgctgagcggttccttaagggccctgaccgattcnctggcgtagaggtctggcgcctcagctcccnggccatcagagggctccaggtctgaagntgaggctgattatactgtacanatcgaggatagactgtgtacggtaccggttccgggttggacggaacggacaagtcgtacgaccgtacgtagtcgacgaccgaacgcctccgaccccgtcggtacctaccgttccgttcccgttcccccgtccccgttacccgtacccgaaccggtacggtacggttaccgtcgggaccggtccgggtacgtacgggaccgaacggtccgacgtaacgtacgcgacncncngngacgcancncang

SEQ ID NO: 399869 - DNA, 557 bp, Homo sapiens
  misc_feature: GZ8MTXP02JMRGP.19.86.H09.1.454.CMB.2.raw
  modified_base (195)..(195): a, c, t, g, unknown or other
  modified_base (301)..(301): a, c, t, g, unknown or other
  modified_base (372)..(372): a, c, t, g, unknown or other
tcagtactctcgtgcacgaccggtgctcgatttagtgctatagacttgggtttgggggaagaggaagactgacggcccactcccaggtgcagctggtgcagtctggggctgaggtgaaggagcctggggcctcagtgaaggtctcctgcgaggcttttggattacaccttcagtcattatcatatactctgggtncgacaggcccctggacaagggcttgagtggatagggcgatccaggtggtagtggtggcgcatacgtcgcacagaagtttcagggccgcgtcaccatgccaaggtcncgtccacgaatacagtcgtatatggacttgagtcaggcctgaggtctgacgacacggcatgtaattattgngcgagcgaggacggataaggacaagtaagtcgtaccgacccgtgggaccgacggaccgtggtcctaccgtctccgtacacgtcctaccgaccgaacggcccacgtccgttccgtccccgcggaccgccgtacgcctaccgacgaccgaccaccgtacgaacgacgacgacgcgcccgccgtcggc

SEQ ID NO: 399870 - DNA, 546 bp, Homo sapiens
  misc_feature: GZ8MTXP02F8WAO.19.86.H09.1.454.CMB.2.raw
  modified_base (356)..(356): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtgtagtggtggcgcatacgtcgcacagaagtttcagggccgcgtcaccatggccaaggtcgcgtccacgaatacagtgtatatggacttgagcagcctgagtctgacgacacggcntgtattatgtgcgaggcagggacggggactaaagggcaagtaaagtggtaccgacccgtggggaccagggaaccctgggtccaccgtctcctcacgccctaccaccgaacgggcccagtccgtcctccccgtggccgccctgacctcgacggacgccgacctccgaagcgcacgcgccggccgtgggccg

SEQ ID NO: 399871 - DNA, 608 bp, Homo sapiens
  misc_feature: GZ8MTXP02JSEEI.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagagcggatccgacgggtggtagtggtggcgcatacgtcgcacagaagtttcagggccgcgtcaccatggccaaggtcgcgtccacgaatacagtgtatatggacttgagcagccctgagtctgacgacacggccatcgtattagtgtgcgaggcgagggacgggacgtaaaggcaagtaaaggtcggtaccgaccccggtggggacccgaacgggaacccgtcgggtaccacccggttcctccgtcgaccgccctacccgaccgaaccgggccctagtcccggtcccttcccccgtcggccccgtcccgtcgcccgtaccgacggaccgacccgacccgtccggaacgaccggccacgaccggcccggtcccggtcgggg

SEQ ID NO: 399872 - DNA, 574 bp, Homo sapiens
  misc_feature: GZ8MTXP02J1DKN.19.86.H09.1.454.CMB.2.raw
  modified_base (358)..(358): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcggatccgaggtggtagtggtggcgtatacgtcgcacagaagtttcagggccgcgtcaccatggccaaggtcgcgtccacgaatacagtgtatatggacttgagcagcctgacggtctgacgacncggccatgtattattgtgcgaggcgagggacggggactaaaggctaagtaaagtcggtccgaccccgtggggcccaacggggaccctgggtaccaccgtctcctcacgccctcccaccacgggcccacgtccggttcccttccccgtggcccgtccctcgcctccgaggacgccacccgtccgacgcgcaccgacggccgcccgtcggggctccgg

SEQ ID NO: 399873 - DNA, 516 bp, Homo sapiens
  misc_feature: GZ8MTXP02FK0LN.19.86.H09.1.454.CMB.2.raw
  modified_base (353)..(353): a, c, t, g, unknown or other
  modified_base (507)..(516): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgcccccaaatcgtcatctataatgacgctgagcggtccttaagggccctgaccgattctctggcgagaggtctggcgcctcagcttccctggccatccagagggctccagtctgaagatgaggctgattattactgtgcaatctgggatgacngtgtgtaacggttccgggtttcggcgggagggaccaagcgtacgacccgtcgtaagtcagcgcgaaggctcgcccctcggtccactctccgtccccgccctcctccacgagacgtacgtggacgcgggctcggacgaacgggcgacacgtacgnnnnnnnnnn

SEQ ID NO: 399874 - DNA, 565 bp, Homo sapiens
  misc_feature: GZ8MTXP02FW96W.19.86.H09.1.454.CMB.2.raw
  modified_base (329)..(329): a, c, t, g, unknown or other
  modified_base (387)..(387): a, c, t, g, unknown or other
  modified_base (530)..(530): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactctgggtgcgacacggcccctggacaagggcttgagtggagtagggcgatccgaggtggtagtgggtggccgcagtacggtcgcacagtaagttcagggccgcgtcaccagtcggccaaggtcgcgtccagaatacagtntatagtggtacttgagacacgcctgaggtctagacgacgacggctgtgtattagttgngacgagggcgaggggacgggactaaaggacaagtaaagtggtacccgacccggtggggccgaacggacctcggtccaccgtctctcgaccgcctacccacgacgccagtccggtcctcccgtgccgccctgcctcgacggacncccgacctcgaagacgcacgtgcccggcctgggcc

SEQ ID NO: 399875 - DNA, 630 bp, Homo sapiens
  misc_feature: GZ8MTXP02J09GW.19.86.H09.1.454.CMB.2.raw
  modified_base (222)..(222): a, c, t, g, unknown or other
  modified_base (585)..(585): a, c, t, g, unknown or other
  modified_base (628)..(628): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttggngagtaggcggacgtcaccggtggtaggtggtggcggcatacgtacggcgacagaagttacgtacggacggccgtcaccactggccgaacggtacggccgtccgaccgaaacgtaacagtaggtatataggtacgttagtaggactacgacgttccgaggggtacgttcgacggaacgacggacccgatgtagtttaattgtgcgaggacgacgggaacgggggtccgtaaagtagacgttaaaagtggtccgtacccgtacggggcggaacggaccgtacgtcgacccggtctcccgtcacgcccgtacccaccgacgggtccgaccttcggtccctcccccgtcgcggccctcgctacccgnggacgcctaccgacccgagcgacactcggcggccctggggacncg

SEQ ID NO: 399876 - DNA, 590 bp, Homo sapiens
  misc_feature: GZ8MTXP02FLM3A.19.86.H09.1.454.CMB.2.raw
  modified_base (319)..(319): a, c, t, g, unknown or other
  modified_base (580)..(590): a, c, t, g, unknown or other
tcagtactctcgtgcacgaccggtgctcgatttagtgctatagacttgggtttgggggccgttcctgggcccagtctgtgctgactcaggcaccctcagcgtctgggacccacgggcagacggtcaccatcgcttgttctgcaagcagctcgaacatcgggagcagtggtgtgatgtggtatcagaaagtcccaggaaccgcccccaaatcgtcatctataatgacgctgagcggtccttaagggtccctgaccgattctctggcgagaggtctggcgcctcagcttcccctggccatcagacggctccagtctgaagntgagctgattattactgtgctaatcgtgggatgacgagtggtagtaaccgggtttccgggttttcgggacgggtacgggtaaccgaagcgtcggtaacccgtaccgtaagtccaggcgacgaacggtccgtccgtcccccgttccgggtacctaccgttccgttcccggttccccctaacccccttccccgtacccgtaaccggacgtaacgtaccgtaggacgggcgggcgtacgggacgaaacggggccacgacgacgnnnnnnnnnnn

SEQ ID NO: 399877 - DNA, 601 bp, Homo sapiens
  misc_feature: GZ8MTXP02HE54M.19.86.H09.1.454.CMB.2.raw
  modified_base (258)..(258): a, c, t, g, unknown or other
tcagtactctcgtgcacgaccggtgctcgatttagtgctatagacttgggtttggggggaagaggaagactgacggtcctgccacaggtggtgctgggcacggtgggcactcgacacaacatttgcgctcaactgtcttgtccaccttggtgcagctggtgcagtctggggctgaggtgaaggagcctggggcctcagtgaaggtctcctgcgaggtcttttggatacaccttcagtcattatcatatactctgggtncgacacggcccctggacaagggcttgagtggatagggcgatccgacggtggtagtggtggcgcatacgtcgacacagtaagtttcgacggggtccgcgtcaccagtcggccgaggtccgcgtaccacgaatacagtagtatatggacttgagcagcctgaggtctagacgacgacggccagttgtatttatgtgcggaggacgaggggacggggactaaaaggctaagtaaaacggtggttaacccggaccccggttcgggggacccgaacgggggtaacccctgggtaacccgtaacccggtccctacccgtaccgaccgaccccgtacccgaaaccccggg

SEQ ID NO: 399878 - DNA, 475 bp, Homo sapiens
  misc_feature: GZ8MTXP02H7TQ9.19.86.H09.1.454.CMB.2.raw
  modified_base (162)..(162): a, c, t, g, unknown or other
  modified_base (257)..(257): a, c, t, g, unknown or other
  modified_base (345)..(345): a, c, t, g, unknown or other
  modified_base (354)..(354): a, c, t, g, unknown or other
  modified_base (380)..(381): a, c, t, g, unknown or other
  modified_base (399)..(399): a, c, t, g, unknown or other
  modified_base (464)..(464): a, c, t, g, unknown or other
  modified_base (466)..(475): a, c, t, g, unknown or other
tcagtactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggancagtggtgtgatgtggtatcagaaagtcccaggaaccggcccccaaatcgtcatctataatgacgctgagcggtaccttaagggtccctgaccgnttctctggcgagaggtctggcgcctcagccttccctggccatcagacgggctcagtctgaagatgaggctgatttatactgtgcatcngggatgacngtgtgacggttcgttgcggagacagnngacgtcagcacgccagcncgccctgcactctcgttcccgccctcaccgagagcgtactgacgcggctcggcaggcgcaagcgngnnnnnnnnnn

SEQ ID NO: 399879 - DNA, 615 bp, Homo sapiens
  misc_feature: GZ8MTXP02JUYUC.19.86.H09.1.454.CMB.2.raw
  modified_base (604)..(606): a, c, t, g, unknown or other
  modified_base (608)..(615): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgtctgcaagcagctcgaacatcgggagcagtggtgtgatgtggtatcagaagtcccaggaaccggccccaaatcgtcatctataatgacgctgagcggtccttaagggtccctgaccgattctcgtggcgagacggtctggcgcctcaggcttccccgtggccatcagagggctcgagtcagaagactgaggtctgaattattactgtacgactagtctgggataggactagtggtaggtaaaccggggttccggttttcggggacgggtaacggggacccaaagggtccgtagtacccgtaccgtaaggtccgaacgcccgaacggtccgtacccggtcccccgttcgggtacctaccgttccgttccggttcccccgcccccttcccgtacccgacgtaccgtacggtaccgtcggacgggtccgggtacgttcgggaccggaaacgggccgacgtacgttagcgcnnngnnnnnnnn

SEQ ID NO: 399880 - DNA, 529 bp, Homo sapiens
  misc_feature: GZ8MTXP02H4FJD.19.86.H09.1.454.CMB.2.raw
  modified_base (352)..(352): a, c, t, g, unknown or other
  modified_base (357)..(357): a, c, t, g, unknown or other
  modified_base (409)..(409): a, c, t, g, unknown or other
  modified_base (435)..(435): a, c, t, g, unknown or other
  modified_base (439)..(439): a, c, t, g, unknown or other
tcagtactctcgtgcacgaccggtgctcgatttagtgctatagacttgggtttgggggaagaggaagactgacggcccccactcccaggtgcagctggtgcagtctggggctgaggtgaaggagcctggggcctcagtgaaggtctcctgcgaggcttttggatacacctttcagtcattatcatatactctgggtgcgacacggcccctggacaagggcttgagtggagtagggcgatccgaggtggtagtggtgcgcatacgtcgcacagaagtttcgagggccgcgtcaccatggccaaggtccgcgtccacgaatacagtgtatatgactgagcagctgagtctgacnacgcntgtattatgtgcgagcaggacgggcgaaagcaataaagtggttccgacccgngggaccaggacctggcaccgtctccncacncctccacgaacggcccagtccgtcctcccctcggccgcctcggcctcgacgcgacccaccgtccgaagcgacacgacgccggcctgggcc

SEQ ID NO: 399881 - DNA, 474 bp, Homo sapiens
  misc_feature: GZ8MTXP02I5HH6.19.86.H09.1.454.CMB.2.raw
  modified_base (422)..(422): a, c, t, g, unknown or other
  modified_base (460)..(474): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacgggctaaaggcaataaagtggttcgacccgtggggccagggaccctggtcacgtctctcagcctcaccaacggcccatccggtctccccgtggccgtccctgcctccgaggacgcccacccgtccggagacgcacgacgccccggccccgtggggctcgccgtggtaccaggggaccctacttaccccgacgaagacgttacngggacggccggggctagggacgaaggccgtacagtagnnnnnnnnnnnnnnn

SEQ ID NO: 399882 - DNA, 559 bp, Homo sapiens
  misc_feature: GZ8MTXP02GN672.19.86.H09.1.454.CMB.2.raw
  modified_base (360)..(360): a, c, t, g, unknown or other
  modified_base (371)..(371): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagttcagggccgcgtcaccatggccaaggtcgcgtccacgaatacagtgtatatggacttgagcagcctgaggtctgacgacacggcntgtattattgngcgaggcagggacgggactaaaggcaagtaaagtggttccgacccgtggggaccacgggaccctggtccaccgtctcctcacgcctaccgaccgaacgggccctagtccggtccttcccccgtgcccgtccctgcctaccgacggacgccaccgtccgaagacgccacgcggccggcccgtggggccc

SEQ ID NO: 399883 - DNA, 549 bp, Homo sapiens
  misc_feature: GZ8MTXP02JKQ86.19.86.H09.1.454.CMB.2.raw
  modified_base (485)..(485): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaaggacttgagtggatagggcggatccgacggtggtagtggtggcgcatacgtcgcacagaagtttcagggccgcgtcaccatggccaaggtcgcgtccacgaatacagtgtatatggacttgagcagctgagtctgacgacacggcatgtattatgtgcgagcagggacgggataaaggcataaagtgttccgacccgtggggccagggaaccctggccaccgtctcctacacgccctaccaccgaacggcccagtccggtccctcccccgnggcccgccctgcctccgacggacgccaccgtccgaacgacgccaacgcgccggcccgtgggccg

SEQ ID NO: 399884 - DNA, 557 bp, Homo sapiens
  misc_feature: GZ8MTXP02GGMXG.19.86.H09.1.454.CMB.2.raw
  modified_base (394)..(394): a, c, t, g, unknown or other
  modified_base (489)..(489): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcatacgtcgcacagaagtttcagggccgcgtcaccagtggccaaggtcgcgtccacgaatacagtgtatatggacttgagcagcctgagtctgacgacacggccatgtattatgtgcgaggcgaggacgggctaaaggnaagtaagtggtccgacccgtggggccgacgggaccctggtccaccgtcgtcctcacgccctccaccgaacgggccctagtccgtccttcccccgngccgccctcgacctccgacggcgaccgacccgtcgaacgacgcaccgacggccggcccgtcgggtccg

SEQ ID NO: 399885 - DNA, 618 bp, Homo sapiens
  misc_feature: GZ8MTXP02H83HR.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccaggtggtagtggtgcgcatacgtcgcacagaagtttcagggccgcgtcaccatggccaaggtcgcgtccacgaatacagtgtatatggacttgagcagcctgagtctgacgacacggccagtgtattattgtgcgaggcagggacggggacgtaaaggacgtaagtaaagttgggtaccgaccccgtgggggtacccgacggggaacccgtcggtacccgaccggtcctcccgtccacgacccctcccgaacccgaacgggtcccctaacgttcccgggttcccgttccccccgtcggtcccggcccccgttgccccgtacccgacgggacgaccacccgtaccggaacgacggccacgacggccgggcccgtcgggcccg

SEQ ID NO: 399886 - DNA, 599 bp, Homo sapiens
  misc_feature: GZ8MTXP02IVRX6.19.86.H09.1.454.CMB.2.raw
  modified_base (196)..(196): a, c, t, g, unknown or other
  modified_base (351)..(351): a, c, t, g, unknown or other
  modified_base (364)..(364): a, c, t, g, unknown or other
  modified_base (464)..(464): a, c, t, g, unknown or other
  modified_base (472)..(472): a, c, t, g, unknown or other
  modified_base (509)..(509): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacacggcccctggacaagggcttgagtggatagggcgatccgaggtggtagtggtggcgcagtacgtcgcacagaagttcagggccgcgtcaccgatggccaaggtcgcgtccaacgaatacagtgtaatagtggacttgagcagctgagtcngacgacgacggcntgttaatagttgtgcggagcgaggggacgggataaaggcaagtaaagtcggtttccgaccccggtggggacccgacgggaacctcggtccaccgtctccncacgcccnccaccgaacggccctacgtccgttacccgtcccccgnggccccgccctcgtcccgtaccgacggtaccgacccacccgtacccgaacggaccgaccgaccggacggtcccggcccggtgggtccccg

SEQ ID NO: 399887 - DNA, 631 bp, Homo sapiens
  misc_feature: GZ8MTXP02JQUIO.19.86.H09.1.454.CMB.2.raw
  modified_base (397)..(397): a, c, t, g, unknown or other
tcagtactctcgtgcacgaccggtgctcgatttagtgctatagacttgggtttggggggaagaggaagactgacggtcccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttggagtggatagggcgatccgaggtggtagtggtggcgcatacgtcgcacagtaagtttcagggcccgcgtccaccagtcggaccaagggtccgcgtacccaacggtaatacgagtgtaatagtggtacttgagcagcctaggcgtctagaccgacacggctattgttattagttgngacggagggacgacggggacgggacgtaaaggacgtaagtaaacggtcggttacccggacccggtcggggaccgacgggtaacccgtcggtccgtaccgtccctcgtcgaccgtccctaccgaaccgacggcccacgttcccggtcccttccccgcggcccgcccgtcgccgtaccgacggccgaccctacccgaccgaacgacgaccacgcggcccggtccggcggtacccgg

SEQ ID NO: 399888 - DNA, 610 bp, Homo sapiens
  misc_feature: GZ8MTXP02JEAT5.19.86.H09.1.454.CMB.2.raw
  modified_base (361)..(361): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaaggacttgagtggatagggcggatccgaggtggtagtggtggcgcatacgtcgcacagaagtttcagggccgcgtcaccatggccaaggtcgcgtccacgaatacagtgtatatggacttgagcagcctgagtctgacgacacggccntgtattagttgtgcgaggcgaggggacggggactaaaggcgaagtaaaggtcggttaccggaccccgttgggggcccgaacggggaaccccgttcgggtcccaccggttccttcccgtccgacgccctacccgaccgaacgggccccacgtccgttcccttcccccgtcggcccgtccccgtcgccctccgacggaccgaccgacccgtccgaacgacgaccgacgcggcccggtcccgtcggggcccg

SEQ ID NO: 399889 - DNA, 611 bp, Homo sapiens
  misc_feature: GZ8MTXP02FQKMA.19.86.H09.1.454.CMB.2.raw
  modified_base (163)..(163): a, c, t, g, unknown or other
  modified_base (222)..(222): a, c, t, g, unknown or other
  modified_base (260)..(260): a, c, t, g, unknown or other
  modified_base (596)..(596): a, c, t, g, unknown or other
  modified_base (600)..(611): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcaagaaagtcccaggaaccggcccccaaatcgtcatctanaatgacgctgagcggtctaagggtccctgaccgattcnctggcgagaggtctggcgcctcacgtccttcccgtggccatcgaggacgggctccgagtctagaagatggaggctgatttattactgtcactaatcgtaggggtatggaactggtcgtagggtaaacgggtttccggttttacggggacgggtacggggaaccaagtcgtacggtacccgttccgtaaacggtcgaaccggaccccgtaaacgggccctccggtccccccgttcgggtaccctaccgttcccgttcccggttccccgcccccttccccgtaccgaaccggagtaacgtccgtcgggacggcgggcgtcggacgaacggcgcgtaanagcnnnnnnnnnnnn

SEQ ID NO: 399890 - DNA, 670 bp, Homo sapiens
  misc_feature: GZ8MTXP02HVCCI.19.86.H09.1.454.CMB.2.raw
  modified_base (344)..(344): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggtcttttggatacaccttcagtcattatcatatactcgtgggtgcgacacggcccctggacaagggcttgagtggagtagggcgatccgacgggtggtagtggcgcgcatcgcgcacagagtttcgagggccgcgtcaccagtcggaccaaggtcgcgtccaacgaatacgagtgtatatggtacttgagnacgtctggagtctggacgacgacggctatgttacttagttgtgcggagggcgaggggaacggggacgtaaacggctaaagtaaacggttcgggttacccgtaccccggtcgggggacccggtaacggggaaccccgttcgggtaccgtaacccgtccgttccctaccgtaccggtcccctaccgaacccggaacccgggtacccgtacgttccccggggtacccctttcccccggtcggccccgtccccgtcggccttacccggacggtaccgccgtacccgtccggaacgacgccgaccgacggtccccggccggtcgggtcccg

SEQ ID NO: 399891 - DNA, 552 bp, Homo sapiens
  misc_feature: GZ8MTXP02JK1WJ.19.86.H09.1.454.CMB.2.raw
  modified_base (359)..(359): a, c, t, g, unknown or other
  modified_base (495)..(495): a, c, t, g, unknown or other
  modified_base (500)..(500): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtgcgcatacgtcgcacagaagtttcagggcccgcgtcaccatggccaaggtcgcgtccacgaatacagtgtatatggacttgagcagcctgagtctgacgacacggccntgtattattgtgcgaggcagggacgggactaaaggcaagtaaaagtggttaccgaccccgtggggaccgacggggaaccctggtccgaccgtctccctcacgcctccaccgaacggcccactccggtccttccccnggccnccctgcctccgacggcgccacctcgaagacgcacgacgccggcccgtggccg

SEQ ID NO: 399892 - DNA, 552 bp, Homo sapiens
  misc_feature: GZ8MTXP02GXLD8.19.86.H09.1.454.CMB.2.raw
  modified_base (195)..(195): a, c, t, g, unknown or other
  modified_base (302)..(302): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagttcagggccgcgtcaccatggccaaggtcncgtccagaatacagtgtatatggacttgagcagcctgagtctgacgacacggccatgtattattgtgcgaggcaggacggggactaaaggcaataaaagtggttaccgacccgtcggggccgacgggaacccgtggtccaccggtctcctcagccctccaccgaacggcccacgtccgtcctccccctggccgcccgtcgcctccgacgacgccaccgtccgaacgcgccacgacgccggcccgtggccg

SEQ ID NO: 399893 - DNA, 586 bp, Homo sapiens
  misc_feature: GZ8MTXP02JIL5H.19.86.H09.1.454.CMB.2.raw
  modified_base (179)..(179): a, c, t, g, unknown or other
tcagtactctcgtgcacgaccggtgctcgatttagtgctatagacttgggtttgggggaagaggaagactgacggcccactcccaggtgcagctggtgcagtctggggctgaggtgaaggagcctggggtctcagtgaaggtctcctgcgaggcttttggatacaccttcagtcattancatatactctgggtgcgacaggcccctggacaagggcttgagtggatagggcggatccgaggtggtagtggtggcgcagtacgtcgcacagaagtttcgagggccgcgtcaccagtcggccaaggtcgcgtccacgaatacagtgtatagtggacttgacgcagcctgagtctgacgacgacggcagtgtattagtgtgcgaggcgagggacgggataaaggcaagtaaagtcggttaccgacccgtcgggggaccacgggaacccgtggtaccaccggtcctacccgtcgacggccctaccgaccgaacgggccctacgtccggttcccttccccgcggcccgtcccgtgcccgtcgacggaccgccaaccgtcgaacgcgacacgcggtccgccggtcggacccg

SEQ ID NO: 399894 - DNA, 570 bp, Homo sapiens
  misc_feature: GZ8MTXP02H7LKK.19.86.H09.1.454.CMB.2.raw
  modified_base (287)..(287): a, c, t, g, unknown or other
tcagtactctcgtgcacgaccggtgctcgatttagtgctatagacttgggtttgggggaagaggaagactgacggcccccactcccaggtgcagctggtgcagtctggggctgaggtgaaggagcctggggcctcagtgaaggtctcctgcgaggcttttggattacaccttcagtctattatcatatactctgggtgcgacaggcccctggacaagggcttgagtggatagggcgatccacggtggtagtggtggcgcatacgtcgcacagaagtttcagggtccncgtcaccatggccaaggtcgcgtccacggaatacagtgtatagtggacttgagcagcctgagtctgacgacacggccatgtaattattgtgcgaggcgagggacggggctaaaggcaagtaaagtcggttccgaccccgtggggacccacgggaaccctggtccaccgtctccctcgacgccctaccgaccgacgggcccagtccggtctcctccgtcggccgccctcgcctccgacggacgcctaccgtccgagtacgccaacgcggtccggcccgtcgggg

SEQ ID NO: 399895 - DNA, 634 bp, Homo sapiens
  misc_feature: GZ8MTXP02JLUU4.19.86.H09.1.454.CMB.2.raw
  modified_base (195)..(195): a, c, t, g, unknown or other
  modified_base (353)..(353): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggccctggacaagggcttgagtggatagggcgatccgagggtggtagtggtggcgcatacgtcgcacagaagtttcgagggccgcgtcaccagtcggaccaaggtcgcgtaccacgaatacagtgtatagtggacttgagcagcctggagtcngacgacacggcagtgtattagttgtgcggaggcgagggacggggacgtaaaggcaagtaaaggtcggttaccggacccggtagggggaccgaaacggggaacccgttcgggtcccaaccggttccctcccgtacaccggtaccctacccgaaccgaacgggcccctaacgttccccggttcccttcccccgcggtccccgtaccccgtcgtacccgtaccgacggaccgacccaccccgtacgaacgacgaccgacggacggcccggcccggttcggcccg

SEQ ID NO: 399896 - DNA, 563 bp, Homo sapiens
  misc_feature: GZ8MTXP02JSSAM.19.86.H09.1.454.CMB.2.raw
  modified_base (358)..(358): a, c, t, g, unknown or other
  modified_base (370)..(370): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccacggtggtagtggtggcgcatacgtcgcacagaagtttcagggccgcgtcaccatggccaaggtcgcgtccagaatacagtgtatatggacttgagcagcctgagtctgacgacacggcntgtaattattgngcgaggtcagggacggggactaaaggcaagtaaagtggttaccgaccccgtggggaccacgggaccctggtaccaccgtctcctcacgcctccgaccgacggccacgtccggtcctcccccgtcggccgcccgtgcctccgacgggacgccacccgtccgaagacgaccgacgacggccggcccgcgggtccg

SEQ ID NO: 399897 - DNA, 552 bp, Homo sapiens
  misc_feature: GZ8MTXP02HO8NO.19.86.H09.1.454.CMB.2.raw
  modified_base (359)..(359): a, c, t, g, unknown or other
  modified_base (539)..(539): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccacgaatacagtgtatatggacttgagcagcctgagtctgacgacacggcngtgtattattgtgcggagcgagggacgggactaaaggcaagtaaagtggttacgacccgtggggccagggaaccctggtccaccggtcttcctcacgccctccgaccgaacgggcccagttcggtcccttccccgtggccgccctcgaccgtccacggacgccacctcgaagacgcacgngccggcctgggcc

SEQ ID NO: 399898 - DNA, 631 bp, Homo sapiens
  misc_feature: GZ8MTXP02GCG8L.19.86.H09.1.454.CMB.2.raw
  modified_base (339)..(339): a, c, t, g, unknown or other
  modified_base (345)..(345): a, c, t, g, unknown or other
  modified_base (363)..(363): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcgatccgaggtggtagtggtggcgcagtacgtcgcacagtagttcagggccgcgtcaccatcggaccaaggtcgcgtaccaacgaatacagtgtatagtgacttgancagtcngagtctgacgacacggcngtgtattagtgtgcgaggcgagggacgggataaaggactaagtaaagtcggtaccgaccccggtcggggaccgaaccgggtaacccgtacggtaccctacccgtccgtccctaccgaccgtccctaccccgaaccgaaaccgggccctaacgttcccggttaccccgttcccccggtcggccccgtccccgtgtcccgtaccggacggtaccgacccgaacccgtccggaacgaccgaccgaccgaccggcccggcccggtcggcccg

SEQ ID NO: 399899 - DNA, 585 bp, Homo sapiens
  misc_feature: GZ8MTXP02JF9DW.19.86.H09.1.454.CMB.2.raw
  modified_base (310)..(310): a, c, t, g, unknown or other
  modified_base (353)..(353): a, c, t, g, unknown or other
  modified_base (365)..(365): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcaggggcccgcgtccaccagtggaccaaggtcncgtccacgaatacagtgtatatggacttgagcagcctgagtcngacgacacggcntgtattagttgtgacggaggcgaagggggacggggactaaaagggcaagttaaaggtcggtacccgaccccggtgggggacccacggggaaccctgggtccaaccggttcctcctcacggcctacccgaaccgaacgggcccagtccggtacccttccccgaggcccgccctgcctaccgacggctccacctcgaagcgcacgacgccggccgtgggccg

SEQ ID NO: 399900 - DNA, 602 bp, Homo sapiens
  misc_feature: GZ8MTXP02GF2XJ.19.86.H09.1.454.CMB.2.raw
  modified_base (529)..(529): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgatccgaggtggtagtggtggcgcatacgtcgcacagtaagttcgagggccgcgtcaccatcggccaaggtcgcgtccaagaatacagtgtatagtggacttgagcagcctggacgtctgaccgacaccggcatgtattagttgtgcggaggcgaagggacgggacgtaaaggcaaagtaaaggttcggtacccgacccggtacggggccgacggggtaacccgtggtcctaccgtccgtcctacgaccgccctacccgaccgaacggcccacgtccgtccctccccgcggcccncccgtgcccgtaccgacggaccgaccacccgtaccgaacgacgaccgaaccgcggcccggtccgtcgggcccg

SEQ ID NO: 399901 - DNA, 606 bp, Homo sapiens
  misc_feature: GZ8MTXP02F7T5Q.19.86.H09.1.454.CMB.2.raw
  modified_base (377)..(377): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacaggcccctggacaagggcttgagtggatagggcgatccgagggtggtagtggtggcgcatacgtcgcacgagaagttcgagggccgcgtcaccagtcggaccaaggtcgcgtccaacgaatacagtgtatatggacttgagcacgccgtgaggtctagacgacgaccggctagttntatttagttgcgcggaggcgaggggacgggtactaaaggcaaagtaaaggttcgtaccgacccggtggggaccgacgggacctcggtccaccgtcctacctcgacgccctacccacgaacggccctacgtcccgtcccgttcccccgcgcccgcccgtcgcctaccgacggaccgcccgacccgtccggaacgccgacgaccggccggccggtacccggtcggtcccgg

SEQ ID NO: 399902 - DNA, 834 bp, Homo sapiens
  misc_feature: GZ8MTXP02I0C38.19.86.H09.1.454.CMB.2.raw
  modified_base (258)..(258): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctctgcgaggtcttttggatacacttcagtcattatcatatactcgtgggtgcgacacggcccctggacaagggcttgagtggagtagggcgatccgaggtggtagtggtgcgnagtacgtcgcacagtaagttcgagggccgcgtacaccgagtggaccgaaggtcgcgtaccagaatacagtgtatagtggtacttgagtcgacgtccgtaggacggttcgtacggaacccggtacgacccgggtacccagtttacggttaaagtttaagttcggtacggggcgggtaaacgggggaccggtaaacgggggtaacgggggtaaaccgttaaaacgggggaacccgttaaaagggttaaaacggggtttacccggggttttaacccccggggaaacccccggggtttccggggggaaccccgggtaaaccgggggtaaacccccggtttcggggtaaccccgtaacccggtttcccgttacccgttaccgacccggtaccccctaaccccgaacccgggtaaccgggtccccgtaacgtttcccgggttaccccgtcccccggtcgggtccccggtcccccgttaggtacccccgtacggtaacggacccgtaccgtaaccccggttacccggaacggaccgaaccggaccggttaccgggcccggttaccccggtcgggggttacccg

SEQ ID NO: 399903 - DNA, 554 bp, Homo sapiens
  misc_feature: GZ8MTXP02I8QVV.19.86.H09.1.454.CMB.2.raw
  modified_base (334)..(334): a, c, t, g, unknown or other
  modified_base (369)..(369): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccgaggtggtagtggtggcgcatacgtcgcacagaagtttcagggccgcgtcaccatggccaaggtcgcgtccagaatacagtgtatatggacttgancagctgaggtctgacgacacggcatgtattattgngcgaggcagacggggactaaaggcaataaagtggttacgaccccgtggggcccagggaccctggtcaccgtctctcacgcctacgaccgaacggccactccggtccttcccccgtcgtcccgccctcgccgtaccgacggacgccaccgtaccgaacgacgacacgacgccggcccgtcggcccg

SEQ ID NO: 399904 - DNA, 588 bp, Homo sapiens
  misc_feature: GZ8MTXP02FJ63L.19.86.H09.1.454.CMB.2.raw
  modified_base (181)..(181): a, c, t, g, unknown or other
  modified_base (337)..(337): a, c, t, g, unknown or other
  modified_base (350)..(350): a, c, t, g, unknown or other
  modified_base (518)..(518): a, c, t, g, unknown or other
  modified_base (524)..(524): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattancatatactctgggtgcgacaggcccctggacaagggcttgagtggatagggcgatccgaggtggtagtggtggcgcatacgtcgcacagtaagttcaggccgcgtcaccatggccaaggtccgcgtccacgaatacagtgtatagtggacttgagnagcctagaggtcngacacgacggcatcgtatttatgtgcgaggcgagggacggggacgtaaaggcaaagtaaagtcggtaccgaccccgtgggggaccgaacgggaacccgtggtcacccgtctcccgttcacgccctcccgaaccgaaacgggtcccacgttccggtcccgttcccccgnggcccncccgtcgacctccgacgacgtccacccgccgaagacgcgaacgccggtaccggcccgtcggccg

SEQ ID NO: 399905 - DNA, 674 bp, Homo sapiens
  misc_feature: GZ8MTXP02JL64X.19.86.H09.1.454.CMB.2.raw
  modified_base (163)..(163): a, c, t, g, unknown or other
  modified_base (265)..(265): a, c, t, g, unknown or other
  modified_base (269)..(269): a, c, t, g, unknown or other
  modified_base (663)..(674): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggancagtggtgtgatgtggtatcgaagaaacgtcccaggaaccggcccccaaatcgtacatctataatgacgctgagcggttaccttaagggtccctagaccgtnttcncgtggcgaggtaggtctggcgcctcacgtccttcccctggacccagtccgaggtacgggccctccgaaggtcctaggaagagtggaggtctagtaatttatacgttgaccgactaagttcgtaggggtataggaacgtggttcggttacgggtaaaccgggggttttccggggttttacgggggcggggtaaacgggaccgtaaacggtccgttacggtaacccgtaccgttaacggtaccgaccggtaccccgaacgggtccctacccgggtccccccgttacggttcccacctttcccgttacccgttaccccctaccccgttcccctacgaccggaacgtacggttacgcgggacggtcgggtcgtaggacccgaagggcaacgagtcgcnnnnnnnnnnnn

SEQ ID NO: 399906 - DNA, 641 bp, Homo sapiens
  misc_feature: GZ8MTXP02JHFZN.19.86.H09.1.454.CMB.2.raw
  modified_base (164)..(164): a, c, t, g, unknown or other
  modified_base (629)..(629): a, c, t, g, unknown or other
  modified_base (631)..(641): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacagtcgggancaggtggtgtgatgtggtatcgaagaaacgtcccgaggaacccggcccccaaactcgtacatctaataatgacgctgagtccggttacttaacgggtccctgaccgtattcgtcgtggcgtaggtacggtctcgggccgtcctcgacgtcccttcccgtggccacgtcgaggacggggtcctccgagttccgtaggaaacgtagtacggaggtctagtaactttattacgtgacgtactagttcgtaggtactagactagggtgttacggtaaccggggtttccgggttcgggacggacgggtaccgaacgtcgtacgaccgtacgtaagaccgtacgacccgacgtccgtcccgcccccgtcgtccgtaccttccgttacccttcccctacccgttccctaccgtacgacgtacgtacggtcggacggtccgggtcgtacggaccgaggacgacgacgtacgcncnnnnnnnnnnn

SEQ ID NO: 399907 - DNA, 582 bp, Homo sapiens
  misc_feature: GZ8MTXP02FE6GZ.19.86.H09.1.454.CMB.2.raw
  modified_base (196)..(196): a, c, t, g, unknown or other
  modified_base (328)..(328): a, c, t, g, unknown or other
  modified_base (350)..(350): a, c, t, g, unknown or other
  modified_base (527)..(527): a, c, t, g, unknown or other
  modified_base (576)..(576): a, c, t, g, unknown or other
tcagtactctcgtgcacgaccggtgctcgatttagtgctatagacttgggtttggggggaagaggaagactgacggcccactcccaggtgcagctggtgcagtctggggctgaggtgaaggagcctggggcctcagtgaaggtctcctgcgaggctttttggatacaccttcagtcattatcatatactctgggtncgacaggcccctggacaagggcttgagtggatagggcgatccgaggtggtagtggtggcgcatacgtcgcacagtaagttcaggggccgcgtcaccatggccaaggtcgcgtccacgaatacagtgtaatanggacttgagcagcctgaggtcngacgacgaccggctatgtattattgtgcgaggcaagggacggggtactaaaggcaagtaaaaggttgttaccgaaccccgtgggggccaacggggaaccctgggtccacccggtctccctccaacgtccctcccgaacgaacgggccccacgtccggtccctttcccccgcgggccnccccgtgcctaccgagacgccaccgtcgaagagcacgagccggtcccgngggtcc

SEQ ID NO: 399908 - DNA, 597 bp, Homo sapiens
  misc_feature: GZ8MTXP02JLSH1.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactcgtggtgcgacaggcccctggacaagggcttgagtggatagggcgatccgaggtggtagtggtggcgcatacgtcgcacagaagtttcgagggccgcgtcaccatcggccaaggtcgcgtccagaatacagtgtatatggacttgagtgctgagtcagacgacacggccatgtattatcgtgcgagcgagggacgggactaaaggctaagtaagtcgggtacgacccccgtggggacccgaaggggtaacccctcggtaccaccgtcctccgtacgtaccgcctacccgaccgaacgggccccagttcccggtccttcccccgtgcccggccctcggccctaccgacgggacgcccgtaccctcgaccgaacgaccgaccgacggcccggtcccgtcggggcctccggg

SEQ ID NO: 399909 - DNA, 577 bp, Homo sapiens
  misc_feature: GZ8MTXP02F8WHH.19.86.H09.1.454.CMB.2.raw
  modified_base (195)..(195): a, c, t, g, unknown or other
  modified_base (305)..(305): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcggatccacggtggtagtggtggcgcatacgtcgcacagaagtttcagggccgcgtcaccatcggccaaggtcncgtccacgaatacagtgtatatggacttgagcagctgagtctgacgacaccggcatgtattattgtgacgaggcagggacgggctaaagggcaagtaaagtcggttccgacccgtggggcccgagggaaccctggtccaccgtcctcctcgagccctcccgaccgacggcccatccggtccctcccccgtgcccgtccctacgtccgtaccgacgaccgccgacccgtaccgaaggacgaccgaccgacggcccggacccgttgggtacccg

SEQ ID NO: 399910 - DNA, 603 bp, Homo sapiens
  misc_feature: GZ8MTXP02FR5B0.19.86.H09.1.454.CMB.2.raw
  modified_base (283)..(283): a, c, t, g, unknown or other
  modified_base (295)..(295): a, c, t, g, unknown or other
  modified_base (316)..(316): a, c, t, g, unknown or other
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgancagcctgagtcngacacacggcatgtattatgngcgagcaggacggactaaaggcaagtaagtcggtaccgacccgtggggccacgggacctgtccaccgtctcctcacgccctccaaccgacggcccacgtcccgttccttcccccgtggcccgcccgtcgccctccgacggaccgaccctacccgtaccgacgcgaccgacgacggccggcccgtggggcctcggcccgtaggtaccgaaacggtaccgttacccgttaccccgaacggtacgtaacgttaccgtacggacgggccgggtccgacgggacgaaacggg

SEQ ID NO: 399911 - DNA, 629 bp, Homo sapiens
  misc_feature: GZ8MTXP02I4KYA.19.86.H09.1.454.CMB.2.raw
  modified_base (195)..(195): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccgaggtggtagtggtggcgcatacgtcgcacagaagtttcgagggccgcgtcaccatcggccaaggtcgcgtccacgaatacagtgtatatggacttgagcagcctgagtctgacgacacggcatgtattatgtgcgaggcgagggacgggactaaagggacgaacgttaaaaggttcgggttacccggaacccccggttacgggggacccgtaacgggggaaccccgttacgggtacccgtaacccgttccgttccctaccgacggtcccctacccgaacccgtacgggacccctaacgtcccgggttcccttcccccgtggcccgtccccgttcgccgtccgacggcgaccaacccgtccgaagacgcgacgacggccggtccgtcggccg

SEQ ID NO: 399912 - DNA, 885 bp, Homo sapiens
  misc_feature: GZ8MTXP02GDTX8.19.86.H09.1.454.CMB.2.raw
  modified_base (198)..(198): a, c, t, g, unknown or other
  modified_base (270)..(270): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggtcttttggatacaccttcagtcattatcatatactcgtgggtnacaacgacggcccctggaacgaagggtcttggagtggagtaggggcgactccgaggtggtaggtggtggcgntacgtacgtcgcaacaggtaacgttcgacggggtccgccggtaccaccaagtcgggacccgtaaagggtccgccggtacccaacggtaaataacgtaggtgttaagtacgttgggtacgtttagacgacgtaacgtccgttaggacggttccgtacgaaccggtaaccgaacccgggaccttagtttacggttaaacttttagtttgggtacgggacggggtaacgggtaccgggtaaacgggggaacgggggttaaacccgtaaaagggacgtaaaacggttaaacgggggtttaccggggtttaccccggaacccccggggtttcggggggaacccggtaaaccgggggtaaccccgtttaacgggggtccccgtaccggtttaccccttcccgttaaccggaccgtcccccgttaacccgaaccccggtaaccgggggtacccctaaccggtttccccgggttccccctttaccccccggggtcccggtacccccgttcccggtttacccggcccgttacccgggaaacggggccccgttacccgaacccgtaccgggaacgtaccgaccggaaaccggccggaccccgggttccggtaccggggttcccgg

SEQ ID NO: 399913 - DNA, 538 bp, Homo sapiens
  misc_feature: GZ8MTXP02JTJ0J.19.86.H09.1.454.CMB.2.raw
  modified_base (356)..(356): a, c, t, g, unknown or other
  modified_base (501)..(501): a, c, t, g, unknown or other
  modified_base (525)..(525): a, c, t, g, unknown or other
  modified_base (527)..(529): a, c, t, g, unknown or other
  modified_base (531)..(538): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccgccccaaatcgtcatctataatgacgctgagcggtccttaagggtccctgaccgattctctggcgagaggtctggcgcctcagccttcccgtggccatcagagggctccagtctgaagatgaggctagattatactgtgcaatcgtagggatgacngtgtcggaacggttccggtttcggacgggtacgggaccaaagcgtagacccgtctaagtccagcccaaggcctacgccccctcggtccacctcgtccgtccccgcccttccctaccgacgtacgacgtacgtggacggtcgggcncggacgaacggccgacgacgagcncnnngnnnnnnnn

SEQ ID NO: 399914 - DNA, 726 bp, Homo sapiens
  misc_feature: GZ8MTXP02GXFX8.19.86.H09.1.454.CMB.2.raw
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcgtatccgaggtggtagtgggtggcgcagtacgtcgcacagaagtttcagggccgcgtcaccgagtcggaccaaggtcgccgtaccgaacgaataccagttagtatatggtacttgagcagctgagtctacgacgacacggcctagtgttattagttagtcgacggtaggcgaaaggggacggggtaacgaaagggtacgaaagttaaaagggttcgggttacccgtaacccccggttacgggggacccgtaaaccgggggaaccccgttacgggtaccccgtaccccgggttaccttaccccgtacctaccgggtaccccctaccccgaaacccggtaaacccggggacccccgtaacgtcccccggtttcccttccccccggttcggccccggtcccgtacctcccgttacccgaacggtcccgtacccgaccccgtaccggaaccgaaccggccgaaccggaccggcccggtcccggtcggggtaccccg

SEQ ID NO: 399915 - DNA, 576 bp, Homo sapiens
  misc_feature: GZ8MTXP02I4UKU.19.86.H09.1.454.CMB.2.raw
  modified_base (197)..(197): a, c, t, g, unknown or other
  modified_base (368)..(368): a, c, t, g, unknown or other
  modified_base (382)..(382): a, c, t, g, unknown or other
  modified_base (537)..(537): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtncgacacggcccctggacaagggcttgagtggatagggcgatccgaggtggtagtggtggcgcatacgtcgcacagtaagtttcgagggccgcgtcaccgagtcggccaaggtcgcgtccaacgatacgagtgtatagtggacttgagcagctgagtctgacgacaccggcntgtattagtgtcgnggaggcgagggacgggataaggctaagtaagtcggtaccgcccggtgggccgacgggacctggtccaccgtcctccgcacgccctacccgaccgacgggccctacgtccgtcctccccgtcggcctccgtcgcctaccgaggaccgacctacccnccggaagacgccgaacgcggtccggccgtcgggtacccg

SEQ ID NO: 399916 - DNA, 565 bp, Homo sapiens
  misc_feature: GZ8MTXP02GO8JO.19.86.H09.1.454.CMB.2.raw
  modified_base (358)..(358): a, c, t, g, unknown or other
  modified_base (384)..(384): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagttcagggccgcgtcaccatggccaaggtcgcgtccacgaatacagtgtatatggacttgagcagcctgagtctgacgacacggcntgtattatgtgcgaggcaggacgggntaaaggcaagtaaaagtggttaccgaccccgtggggacccagggaaccctggtccaccgtcgtacctcagccctccaaccgtaacgggcccacgtccgggtccttcccccgtcggcccgccccgtgcctccgacggacgccaaccgtccgaagacgccacgacgccggcccgtcgggtccg

SEQ ID NO: 399917 - DNA, 724 bp, Homo sapiens
  misc_feature: GZ8MTXP02I7RD5.19.86.H09.1.454.CMB.2.raw
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggtcttttggatacaccttcagtcattatcatatactcgtgggtgcgacacggcccctggacgaagggtcttgagtggagtaggggcgatccgaggtggtagtgggtggcacagtacgtcgcacgaagtaagttcgacgggccgcgtacaccagtcggaccgaagggtccgccgtaccaacgtaaactacgagtcgtaatagtacggtacttggaacgtcgacggtcctaggacggttcgtacgaaccgtaccgaaccggtcctagtttacgttaagtttagttcggtcgggacggagggacggaacgggggtacgggaacgtaaagggacgtaaagtaaaggttcgtacccgtacccggtaggggcccgaaacgggtacccgtcgggtacctacccggttcctccgtaccgaccgtacccctacccgaacccggtacggccccgtaacgttcccggttcccctcccccggtcggtccccgtccccgtggtccccgttacggaaccggtccgacccgtaacccgtccggaacggacgaccgaaccggacgggcccggtccggtcgggtcccg

SEQ ID NO: 399918 - DNA, 647 bp, Homo sapiens
  misc_feature: GZ8MTXP02G9GYT.19.86.H09.1.454.CMB.2.raw
tcagtactctcgtgcacgaccggtgctcgatttagtgctatagacttgggtctggggctgaggtgaaggagcctggggcctcagtgaaggtctcctgcgaggcttttggatacaccttcagtcattatcatatactctgggtgcgacaggcccctggacaagggcttgagtggatagggcggatccgacggtggtaggtggtggcgcatacgtcgcacagtaagtttcagggccgcgtcaccagtggaccaaggtcgcgtccagaatacagtgtatactggactgagcagcctgagtctgacgacacggcagtgtattagtgtgcggaggacgaggggacggacgtaaaggcaagttaaagtcggttaccgaacccgtggggaccgaacgggtaccctgtaccgaccgtcctcctaccacgtcccacccaaccggacgggcccctagtcccggtcccttcccccgtcgcccgtcccgtacgcctaccggacgcgacccaccgtaccggacgacgacccgacgaccggcccggacccgtcgggtcccgtcggtccggtacgggttaccgaaacgggttaccctaacccgttacccccaggtacggaacgttcccggagggaccggtcgggtacacggggacgaacggg

SEQ ID NO: 399919 - DNA, 592 bp, Homo sapiens
  misc_feature: GZ8MTXP02GWOA9.19.86.H09.1.454.CMB.2.raw
  modified_base (195)..(195): a, c, t, g, unknown or other
  modified_base (455)..(455): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtgtagtggtggcgcatacgtcggcacagaagtttcagggccgcgtcaccatggccaaggtcgcgtccacgaatacagtcgtatatggacttgagcagcctgagtctgacgacacggccatgatttatgtgcgagggcagggacggggactaaaggacgataaaagtggttccgacccgtcgggggccacgggacccgtggtcaaccgtcgtaccnctacggccctaccgaccacggggacccacgtcccggtccgttccccccgtcggcccgtcccctcggccttcccgaacgggaccgccaacccgtcccggaacgaacgcccacggacgccgggccccgtgggggtcccg

SEQ ID NO: 399920 - DNA, 722 bp, Homo sapiens
  misc_feature: GZ8MTXP02H0UL3.19.86.H09.1.454.CMB.2.raw
  modified_base (134)..(134): a, c, t, g, unknown or other
  modified_base (257)..(257): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctnagtgaaggtctcctgcgaggcttttggatacaccttcagtcattatcatatactctgggtgcgacgacggcccctggacaagggcttgagtggagtagggcgatccgaggtggtagtggtgcnatacgcgcacagaagttcacgggccgcgtcaccagtcggcccaaggtccgccgtccaacgaatacagtgtattacgtaggtacttggaaagccgaacggtcctaggtagggtcctacggaaccgaaccaccgggtcctagttagttaatttagttgtgaccggaagggccgaaggggtaacggggaaactaaaagggacgtaaagtaaaacggttggttaacccgaaccccgtacggggaccccgtacgggaaacccgttacgggacctaacccggtcgtacccttaccgacggtacccctaccgaaacccggaaaccgggcccctaacggttcccggtacccgtttccccccgcgggtccccggccccttccgcccgtacccggaaacgggtaccgaccctaaccccgaccggaacgggacccaccgaccgaccggttcccggacccccggttaggggccccgg

SEQ ID NO: 399921 - DNA, 606 bp, Homo sapiens
  misc_feature: GZ8MTXP02FI9CH.19.86.H09.1.454.CMB.2.raw
  modified_base (396)..(396): a, c, t, g, unknown or other
  modified_base (489)..(489): a, c, t, g, unknown or other
  modified_base (577)..(577): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacagcccctggacaagggcttgagtggagtagggcggatccgacggtggtagtggtggcgcatacgtcgcacgagaagttcagggccgcgtcaccatggaccaaggtccgcgtacccaacggaataccgagttgtaatagtggactttgaagcaggcctggaggttcaggacgacaccggcctatgttattagtttgnggacgagggcgaggggacgggacctaaaaggctaaagtaaagttcggtaccgacccgtggggccgaacgggaccccttggacccaccggtccnccgtccgacgtacctcccgaaacccggaacggtcccctagtcccgtcccttcccccgtggcccctccgtcgccctacgacggcgcccnctccgaagcgcacgcgccgccgcggtccg

SEQ ID NO: 399922 - DNA, 541 bp, Homo sapiens
  misc_feature: GZ8MTXP02JF921.19.86.H09.1.454.CMB.2.raw
  modified_base (284)..(284): a, c, t, g, unknown or other
  modified_base (374)..(374): a, c, t, g, unknown or other
  modified_base (483)..(483): a, c, t, g, unknown or other
  modified_base (487)..(487): a, c, t, g, unknown or other
tcagtactctcgtgcacgaccggtgctcgatttagtgctatagacttgggtttgggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacacggcccctggacaagggcttgagtggatagggcggatccgaggtggtagtggtggcgcatacgtcgcacagaagttcagggccncgtcaccatggccaaggtcgcgtccacgaatacagtgtatagtggacttgagcagcctgagtctgacgacacggcagtcgttatagttgngcgaggcgagggcgggactaaggcagtaaagtgtacccgcccggtgggccagggacctggccaccgtctccgctacgcctccgacgaacggccagtccgtcctccccgngccncccgtgacctcgacgcgaccaccgtcgaacgcgacacgtaggccgcccgtggcg

SEQ ID NO: 399923 - DNA, 726 bp, Homo sapiens
  misc_feature: GZ8MTXP02FGYQW.19.86.H09.1.454.CMB.2.raw
  modified_base (290)..(290): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttggagtggatagggcgatccgacggtggtaggtggtggcgcatacgtcgcaacagtaagttcgagggcccncgtcaccgagtcggccgaaggtcgccgtccgaacgaatacgagttgtaatagtggacttggaacgcgaaggtcccgtggaacggttcctaggaaccgaacgacccggggtacctagttgttaaattttaaggttggtacgtacgggaagggtaccgaaagggggtaccgggggtaacgtaaaagggactaaagttaaaggttcgggtacccggtaacccccggtgggggtacccgaaacgggggtaaccccgttgggtaaccccgtaacccggttcccgtcccgtacaaccggtcccctaaccccgaccgaaaacggggccccctacggttcccgggtacccttcccccgtcggccccgtccctcggaccctccgaaacggaccgtaccgaccgtaccggaacgacggaccacgacggcccggtccggtcggcccg

SEQ ID NO: 399924 - DNA, 607 bp, Homo sapiens
  misc_feature: GZ8MTXP02JVO5N.19.86.H09.1.454.CMB.2.raw
  modified_base (275)..(275): a, c, t, g, unknown or other
  modified_base (590)..(590): a, c, t, g, unknown or other
  modified_base (593)..(593): a, c, t, g, unknown or other
  modified_base (595)..(597): a, c, t, g, unknown or other
  modified_base (599)..(599): a, c, t, g, unknown or other
  modified_base (601)..(601): a, c, t, g, unknown or other
  modified_base (603)..(607): a, c, t, g, unknown or other
tcagtactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaacgtcccaggaaccggcccccaaatcgtcatctataatgacgctgagccggttaccttaagggtccctgaccgtattctctggcgagnggtctggccgcctcacgtccttcccgtggccatcgaggacgggtcctcccgagtcctaggaacgtagtgaggtcttgtaatttattacgtgtacgactaagtcgtagggatgacgtaggtggtacggtaccggggtttcgggtttcgggacgggtacggaccaagtccgtacgacccgtactaacgccgtacgacccgaacggtcccctacccccgtggtccctaccgtccttcccgttcccccgccctcccgtaccgaccggtagtccgtacgtcggacggcccgggtgacgggacgtacgggcacgacggtangcncnnngncncnnnnn

SEQ ID NO: 399925 - DNA, 717 bp, Homo sapiens
  misc_feature: GZ8MTXP02JQ8KP.19.86.H09.1.454.CMB.2.raw
  modified_base (135)..(135): a, c, t, g, unknown or other
  modified_base (406)..(406): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctnagtgaaggtctcctgcgaggcttttggatacaccttcagtcattatcatatactcgtgggtgcgacacggcccctggacgaagggcttggaggttggagtaggggcgtatccgacgggtggtaggtgggtggcgcacgtacggtcgcaacgaggtaagtttcgacggggccgcgtcaccagtggaccaaggtccgcgtccacgaatacagtgtatgtggacttgagcagtctggacgtctgaccgtacgaccggctgtcgtattagttggngcggagcgaggggtacggggactaaaggctaagttaaagggtcggttacccgacccggtcgggggaccgtaccggggacccgttacggggaccctaccggttccctacccgttacaaccgggtcccccttaacccgaacccggaaacccggggtccccctaacggttccccggtttaaccccgtttcccccggtcgggcccccgttcccgtaccggtcccgttaccggaccggaccgaccccgtaccccgttaccggaaggaaccgttccggaaaccgccggacccccgggttaccgtccgggggtacccg

SEQ ID NO: 399926 - DNA, 675 bp, Homo sapiens
  misc_feature: GZ8MTXP02JGGKJ.19.86.H09.1.454.CMB.2.raw
  modified_base (136)..(136): a, c, t, g, unknown or other
  modified_base (183)..(183): a, c, t, g, unknown or other
  modified_base (624)..(624): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagccgtggggcctnagtgaaggtctcctgcgaggtcttttggatacaccttcagtcattancatatactcgtgggtgcgacgacggcccctaggaacgaagggtcttaggaggtggagtacgggcggtactccggaggttggtaggtggtggcgcagtacggtcgacacgaggtaacgttcgacgggccgcgtacaccagtcggaccgtaacgggtccaccgtaccgaagtaaactacgtagttacgtaagtagtcggtaacttggaacgtcgacggtcctagggtacgtcacggaccgacgaccggactagttgttaatttggtgtcggacggtacgggacgaacgggggacggtaacgaaagtcgaaacggttaaacgggtcgtaccccggacccggtaaccggggccgaaccgggttacctcggtcccgtaccgtccttccgacgaccgtacccgaccgacgaccggcctacggtccgtccctccgcgaccgtccgtancccgcggaacgccgtccaccgagaacggcacgacgtccgccgtacggcgcg

SEQ ID NO: 399927 - DNA, 536 bp, Homo sapiens
  misc_feature: GZ8MTXP02FRUB4.19.86.H09.1.454.CMB.2.raw
  modified_base (197)..(197): a, c, t, g, unknown or other
  modified_base (282)..(282): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (377)..(377): a, c, t, g, unknown or other
  modified_base (381)..(381): a, c, t, g, unknown or other
  modified_base (395)..(395): a, c, t, g, unknown or other
  modified_base (417)..(417): a, c, t, g, unknown or other
  modified_base (433)..(433): a, c, t, g, unknown or other
  modified_base (467)..(467): a, c, t, g, unknown or other
tcagtactctcgtgcacgaccggtgctcgatttagtgctatagacttggggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttgagtggatagggcgatccaggtggtagtggtggcgcatacgtgcacagaagttcagggccncgtcaccatggaccaaggtcgcgtccacgaatcagtgatatggacttgagcagcctagagtcngacganacggcngtgtattatgtgcgagcagngggntaaaggcataaagngtcgacccgtgggaccagaccnggcaccgtctccgtcncgacctccaccgacggccacgtcgtcctccccgngccgccctcgcctccacggtacgaccgaccctccgaagaccggacacgagccggccccgtggggtcccg

SEQ ID NO: 399928 - DNA, 508 bp, Homo sapiens
  misc_feature: GZ8MTXP02HX12H.19.86.H09.1.454.CMB.2.raw
  modified_base (453)..(453): a, c, t, g, unknown or other
  modified_base (484)..(484): a, c, t, g, unknown or other
  modified_base (488)..(489): a, c, t, g, unknown or other
  modified_base (491)..(508): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcagggacgggactaaaggcaataaaggtcggttacgaccccgtggggaccacgggaaccctggccaccgtctcctcacgccctaccaccgacggcccatccggtcttccccccgtggccgccctgcctaccgacggacgccctacccgtccggagcgaccacgaggcccccgcccgtcgggctcggccgttacggtaccaacggggtaccttaacccttaccccgaacgacgtaacgtacngggaacggcggacgtcggagacgggacctanaagnncnnnnnnnnnnnnnnnnnn

SEQ ID NO: 399929 - DNA, 666 bp, Homo sapiens
  misc_feature: GZ8MTXP02JQ2MU.19.86.H09.1.454.CMB.2.raw
  modified_base (196)..(196): a, c, t, g, unknown or other
  modified_base (267)..(267): a, c, t, g, unknown or other
  modified_base (627)..(627): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactctgggtncgacaggcccctggacaagggcttggagtggatagggcgatccgaggtggtagtggtggcgcatacgtcgnacagaagtttcagggccgcgtcaccagtcggccaaggtcgcgtccaacggaatacacgtgtaatatggtaacttggagcacgtcctggaggtcctgacgacgaccggcatgttaattacgttgtgacgagggcgacgggacgggggacgtaaaggccaaagttaaacggtacggttaccgaccccggtcgggggacccgtaaccggggtaaaccccgtcggggttcccaaacccggttccgttacccgttacgaccggtccccttaaccccgaacccgaaaccggggtccccacggttccggttaccccttcccccgtcgggcccgtccccgttcgccctccgaacggacgcccgtaccnccggaacgcgaccgaccgacggtccggccgtcgggcccg

SEQ ID NO: 399930 - DNA, 543 bp, Homo sapiens
  misc_feature: GZ8MTXP02HPW8L.19.86.H09.1.454.CMB.2.raw
  modified_base (296)..(296): a, c, t, g, unknown or other
  modified_base (525)..(525): a, c, t, g, unknown or other
  modified_base (527)..(543): a, c, t, g, unknown or other
tcagtactctcgtgcacgaccggtgctcgatttagtgctatagacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggcatgtattattgtgcgaggcgaggggacgggataaaggctaagtaaaggtcggttaccggaccccggtggggaccgacggggaaccctggtcctaccgtctccncgtacgccctaccaaccgacggccctagtccggttcccctttcccccgtggcccctccccgtcgtcccgtaccgacggacgacccacccgtccggaaggacgacgacggtaccggcccccggccgtcgggccgtcggtaccgtcggaacgacgggtaccttacccttcccgaacggtaagtacgtaacgtcggacggggtcgggacgtcgggacgtacgggcgactagngnnnnnnnnnnnnnnnnn

SEQ ID NO: 399931 - DNA, 626 bp, Homo sapiens
  misc_feature: GZ8MTXP02FXQL1.19.86.H09.1.454.CMB.2.raw
  modified_base (257)..(257): a, c, t, g, unknown or other
  modified_base (301)..(301): a, c, t, g, unknown or other
  modified_base (340)..(340): a, c, t, g, unknown or other
tcagtactctcgtgcacgaccggtgctcgatttagtgctatagacttgggtttggggggaagaggaagactgacggccccactcccaggtgcagctggtgcagtctggggctgaggtgaaggagcctggggcctcagtgaaggtctcctgcgaggcttttggatacaccttcagtcattatcatatactcgtgggtgcgacaggcccctggacaagggcttgagtggatgggcgtatccgaggtggtagtggtggcnctatacgtcgcaaccagtagtttcagggcccgcggtcaacccgngtacggacgaggtcgcgaccagaatacgagtagtatagngtactgagcgacgtctagacgtcgacgacgacaccggtcagttatagttacgtgagcggacggacgaacggggacggtaactaaaggactaagttaaacggtcggtaccgacccggtacggggaccgacggtaccgtcggtaccgaccgttaccgtcctacgacgtaccacccgacgaccggcctacgtccgtaccgtcccgtcggtcccgtccgtacgccgtacgacggtaccgaccacccggtacgaacgacgaccgacgtaccgacccggtaccggacggtcg

SEQ ID NO: 399932 - DNA, 700 bp, Homo sapiens
  misc_feature: GZ8MTXP01AJ6NC.4.22.B11.1.454.CMB.2.raw
  modified_base (239)..(239): a, c, t, g, unknown or other
  modified_base (265)..(265): a, c, t, g, unknown or other
  modified_base (293)..(293): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagctgggttttccttgttgctattttcaaaggtgtccaatgtgaggtgcaactgctggagtcgtgggggagcttggacagccagggcgctcccngacactctcctgtacacttctggtcntctgctgtattatacttgacctggtccncaggctccgagggagggctggagtggtatttggtttacagttagaagtctaaaacgttgtgggtaggaccaccgaaagaactaagtcgacccgtgttaccgtgggtaggaaaacgggcaaggtacttaccaactaactactacgaaagaaggtaattaggtaaactttaaccaaaaggttcgtaaccggtaccccgttaacccttacccgaagtaaccgttagtaaccggttaacgacccgtttaaacggaaacgtaaaccccgggaaaaggtaaccccttactaaacccggttaccccttttaatttaaacccgttggttacgtaccgttaaggagttacgttaaccggtaccgttccgggtaccccggtttaacggttcgttttcggggaaccggttccccgggg

SEQ ID NO: 399933 - DNA, 451 bp, Homo sapiens
  misc_feature: GZ8MTXP01E15YB.4.22.B11.1.454.CMB.2.raw
  modified_base (372)..(372): a, c, t, g, unknown or other
  modified_base (389)..(389): a, c, t, g, unknown or other
  modified_base (391)..(391): a, c, t, g, unknown or other
  modified_base (422)..(422): a, c, t, g, unknown or other
  modified_base (425)..(425): a, c, t, g, unknown or other
  modified_base (429)..(429): a, c, t, g, unknown or other
  modified_base (431)..(431): a, c, t, g, unknown or other
  modified_base (437)..(437): a, c, t, g, unknown or other
  modified_base (445)..(445): a, c, t, g, unknown or other
  modified_base (448)..(448): a, c, t, g, unknown or other
  modified_base (450)..(451): a, c, t, g, unknown or other
tcagagcactgtagcacgaccggtgctcgatttagacgacagctccagggaaggggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagtccctttattactgtgctagagatcgactggcccgttagtatttttggcgtcggccccgacggaacatcctcagactccgtggggtcagggacccctggtcacccgtctcctcagccctccaccaacgggcccatccggtccttccccctgccaccctcctccccagngccacctcgtgggggcncngccgcctgggctgcctggcaagctactccangtnctcngngcggcngcagggcncangnn

SEQ ID NO: 399934 - DNA, 535 bp, Homo sapiens
  misc_feature: GZ8MTXP02IUK89.4.22.B11.1.454.CMB.2.raw
  modified_base (372)..(372): a, c, t, g, unknown or other
tcagagcactgtagcacgaccggtgctcgatttagacgacagctcaggggagctctgggagaggagcccagccgtgagattcccaggagtttccacttggtgatcagcactgaacacagaccaccaaccatggagtttgggcttagctgggtttccttgttgctattttcaaaggtgtccaatgtgaggtgcaactgctgggagtcgtgggggaggcttgggtacagccgagggcgctccctgacactctcctgtaccaacttctgggttcatctttgctgattatacttgacctggtccgcaggctccgaggggaagggctggagtgggattggtttcattagaagcaaaacttatggtggacacagaatntgccgcgtctgtagaaaggcagatcacatctcaagagatgattaccaaaagtgtcgtcctacctccacgatgactagcctgaaagaccgaagactacacgtccctttattactgtcgctagagaatcgactcggtacccgttacgtagttttcggcgtccggg

SEQ ID NO: 399935 - DNA, 460 bp, Homo sapiens
  misc_feature: GZ8MTXP02F09RH.4.22.B11.1.454.CMB.2.raw
  modified_base (380)..(380): a, c, t, g, unknown or other
  modified_base (455)..(460): a, c, t, g, unknown or other
tcagagcactgtagcacgaccggtgctcgatttagacgacagctccagggaaggggctggagtggattggtttcattagaagcaaaacttatggtgggacaccagaatatgccgcgtctgtgaaaggcagattcaccatctcaagagatgattccaaaagtgtcgcctacctccagatgactagcctgaagaccgaagactcagccctttattactgtgctagagatcgactggcccgttacgattttggcgtggccccgacggacatcctcagactcctggggtcagggaaccctggtcaccgtctcctcagcctccaccagggcccatcggtcttccccctggcacccctcctccccaagacgcacctctcgggggcnccgagcggccctggggctgcctggtcaaggactacttccctacagtgctctgagcgggctggcaaggcgcatagnnnnnn

SEQ ID NO: 399936 - DNA, 542 bp, Homo sapiens
  misc_feature: GZ8MTXP02GK5QD.4.22.B11.1.454.CMB.2.raw
  modified_base (232)..(232): a, c, t, g, unknown or other
  modified_base (354)..(354): a, c, t, g, unknown or other
  modified_base (370)..(370): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttggcttagctgggttttccttgttgctatttcaaggtgtccaatgtgaggtgcaactgctggagtcgtgggggagcttggtacagccaggggcnctccctgacactctcctgtacaacttctgggttcatcttgctgattatactttgacctggtccgccaggctccgaggggaaggggctgggagtggattggttcagttagaagacaaaacttnggtgggacacagaatntgccgcgtctgtagaaagcagattcacatctacaagagatagataccaaaagtgtacgcctacctacagatgactagcctagaacgaccgaagacacgacgtaccctttattacctgtacgacgtagagactcgacgtacggtcccgttacgtacgttttacggcgtaccgg

SEQ ID NO: 399937 - DNA, 574 bp, Homo sapiens
  misc_feature: GZ8MTXP02HMJBL.4.22.B11.1.454.CMB.2.raw
  modified_base (263)..(263): a, c, t, g, unknown or other
  modified_base (298)..(298): a, c, t, g, unknown or other
  modified_base (350)..(350): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagctgggttttccttgttgctattttcaaaggtgtccaatgtgaggtgcaactgctggagtctgggggaggcttgggtacagccagggcgctccctgacactctcctgtacaacttcnggttcatcttgctgattatacttgacctgggtccncaggctccagggaggctggagtggattggtttcatttagaagcaaaaccttntggtgggacaccagaatatgccgcgtctgtgaaagggcagattcaccatctcaagagatagattaccaaaagtgtcgacctacctccagatgactagcctagaacgaaccgaacgactccgtaacgaccccttttattaaccttggtagtaccgttaacgaggtaactcggtacgtacgggtaccccgtttaacggtactttttacggggacggtttcccgggg

SEQ ID NO: 399938 - DNA, 579 bp, Homo sapiens
  misc_feature: GZ8MTXP02H8UKW.4.22.B11.1.454.CMB.2.raw
  modified_base (303)..(303): a, c, t, g, unknown or other
  modified_base (378)..(378): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagcttgggttttccttgttgctattttcaaaggtgtccaatgtgaggtgcaactgctggagtcgtgggggagcttggtacagccaggggcgctccctgacactctcctgtactaacttctgggttcatctttgctgtattatactttgacctggtccnccaggctccgagggagggctggagtggattggttcagttagaagtacaaaacttgaggtcgggaacaccagaatntgccgcgtctgtagaaagcagatcaccatctacaaagagatagaacttaccaaaagtcgtaccgaccttacctaccaagatacgactagacctagaacgaaccgaacgactacacgtaccctttacgtacttacgtcgtacgtacgtagacgtcgaacgtcggtaccccgttacgttacgttttacgggtacggttcccgg

SEQ ID NO: 399939 - DNA, 535 bp, Homo sapiens
  misc_feature: GZ8MTXP02I1YVA.4.22.B11.1.454.CMB.2.raw
  modified_base (304)..(304): a, c, t, g, unknown or other
  modified_base (330)..(330): a, c, t, g, unknown or other
  modified_base (361)..(361): a, c, t, g, unknown or other
  modified_base (378)..(378): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagcttgggttttccttgttgcttattttcaaaggtgtccaatgtgaggtgcaactgctggagtcgtgggggagcttggtacagccgagggcgctccctgaccactctcctgtacaacttctgggttcatctttgctgattatactttgacctgggtccnccaggctccgaggggaaggggctggngtgggattggtttcattagaagcaaaacttntgtgggacaccagaatntgccgcgtctgtagaaaggtcagattcacatctcaagagatgattaccaaaagtcgtacgcctacctcagatgactacgctgaaagccgaagactcacgtccctttatactgtgctagagatcgacgtcggacccgttagtacgtttcggcgtccgg

SEQ ID NO: 399940 - DNA, 687 bp, Homo sapiens
  misc_feature: GZ8MTXP02J0SJT.4.22.B11.1.454.CMB.2.raw
  modified_base (298)..(298): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagctgggttttccttgttgctattttcaaaggtgtccaatgtgaggtgcaactgctggagtcgtgggggagcttggtacagccgagggcgcctccctgacactctcctgtacaacttctggttcatcttgctgattatacttgacctggtccncaggctcgagggagggctggagtggtattggttcagttaagaaagactaaaaaccttgtagggtaggtaccaccgaagaacttgcgcccgtcgtctaggtagaaaagggcaagtacttacacctatacctacgaagaagtagtacgtaacttaaccgaaaaagttcgtacccgtaccctaaccctacccgaagtacgtacgaaccttacggaccccgtaaggaaacggaacccgaaacgtacctaacgtaacccggtttaccccttttaaattaccgttacggttccgtacgttaaagggaacgtaacgtaaccggtaaccgttcgggggttaacccccgttttaagggtttaccggtttttccggggaccgggtttaacccccggggg

SEQ ID NO: 399941 - DNA, 555 bp, Homo sapiens
  misc_feature: GZ8MTXP02II0LA.4.22.B11.1.454.CMB.2.raw
  modified_base (404)..(404): a, c, t, g, unknown or other
  modified_base (406)..(406): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagctgggttttccttgttgctattttcaaaggtgtccaatgtgaggtgcaactgctggagtcgtgggggaggtcttggtacagccgagggcgctccctgacactctcctgtacaacttctggttcatcttgctgattatacttgacctggtccgcaggctcgaggggagggctggagtggattggtttcagttagaagactaaaacttgtggtggacacagatagtgccgtgtctgtagaaaggcagattcacatctanangatgatactaaagtgtacgacctacctcagtactacgactacgcctagaaacgaccgaagactacgtacgtaccctttatacgtagtgactaaggctaagtcgaccgttcggtacccgtttacggttacgttttcggcggtttcccggg

SEQ ID NO: 399942 - DNA, 608 bp, Homo sapiens
  misc_feature: GZ8MTXP02GNN8B.4.22.B11.1.454.CMB.2.raw
  modified_base (234)..(234): a, c, t, g, unknown or other
  modified_base (244)..(244): a, c, t, g, unknown or other
  modified_base (297)..(297): a, c, t, g, unknown or other
  modified_base (340)..(340): a, c, t, g, unknown or other
  modified_base (352)..(352): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttggcttagctgggttttccttgttgctattttcaaggtgtccaatgtgaggtgcaactgctggagtcgtgggggagtcttggtacagccgagggcnctccctgacnctctcctgtacaacttctggttcatcttgctgtattatacttgacctggtccncaggctccgaggggagggctggagtggattggttcattagaanactaaaacttgnggtggacacgagaatgtgccgtctcgtagtagaaaggcagtattacaccatactacgaagagatagtaacttacgaaaagtcgtaccgtacccttaccctacccgagtacgtacgaactacggtaccgtacggaaacggaaccgaaacgtacctacctaacgtaccctttaattaccgttagtcgtaccgtaaggacgtacgtaacgtacgtcgggttacccgttacgttacggttttacgggcggttacccgggg

SEQ ID NO: 399943 - DNA, 628 bp, Homo sapiens
  misc_feature: GZ8MTXP02IU9RX.4.22.B11.1.454.CMB.2.raw
  modified_base (235)..(235): a, c, t, g, unknown or other
  modified_base (384)..(384): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagctgggttttccttgttgctattttcaaaggtgtccaatgtgaggtgcaactgctggagtcgtgggggagcttggtacagccgagggcnctccctgacactctcctgtactaacttctgggttcatctttgctgtattatacttcgacccggtccgcgagctcgaggggagggctggagtggatttggtttcagttagaagactaaaacttgtagggtacggacaaccagtaactagngccgtcgtcgtgtaggaaagcagtaatcaccatctacaaagagtatagaacttaaccaaaagtcgtaccgacccttacctaccgtagactagaactacgaccgtaggaaaccgaaacgaacgtacctacgtacgttaccctttaattacgtcgttacgacctaaggtactaacgttaccgtaacgttacggtacccccggtttaagttaaccggtttttcggaccgggtaccggtaacccccgg

SEQ ID NO: 399944 - DNA, 570 bp, Homo sapiens
  misc_feature: GZ8MTXP02FOSYM.4.22.B11.1.454.CMB.2.raw
  modified_base (303)..(303): a, c, t, g, unknown or other
  modified_base (364)..(364): a, c, t, g, unknown or other
  modified_base (384)..(384): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttgggcttagcttgggttttccttgttgcttattttcaaaggtgtccaatgtgaggtgcaactgctggagtcgtgggggaggcttggtacagccgagggcgctccctgacactctcctgtacaacttctgggttcatcttgctgattatactttgacctgggtccncaggctccgaggggaagggctgggagtggatttgggtttcagttagaaagcaaaaaccttntgggtagggacaccagaatntgccgcgtctgtagaaaggcagattcaccatctacaagagaatgaacttaccaaaagttgtccgacctacctccagatgactagcctagaacgaccgaaagactacacgtaccctttattactgtcgtacgtagacgtatcgtacgtcggtccccgtttagtacgtttttcgggcggttacccggg

SEQ ID NO: 399945 - DNA, 541 bp, Homo sapiens
  misc_feature: GZ8MTXP02JI1AH.4.22.B11.1.454.CMB.2.raw
  modified_base (253)..(253): a, c, t, g, unknown or other
  modified_base (313)..(313): a, c, t, g, unknown or other
  modified_base (316)..(316): a, c, t, g, unknown or other
  modified_base (345)..(345): a, c, t, g, unknown or other
  modified_base (380)..(380): a, c, t, g, unknown or other
  modified_base (515)..(515): a, c, t, g, unknown or other
  modified_base (517)..(517): a, c, t, g, unknown or other
  modified_base (519)..(541): a, c, t, g, unknown or other
tcagagcactgtagcacgaccggtgctcgatttagacgacagctcagggaaggggctggagtggattggtttcattagaagcaaaacttatggtgggacaccagaatatgccgcgtctgtgaaaggcagattcaccatctcaagagatgattaccaaaagtgtcgcctacctccagatgactagcctgaagaccgaagactcagtccctttattactgtgctagagatcgatcggcccgttagtatttttggngtcggccccgaggaacatcctcagctccgtgggtcagggaaccctggccaccgtctcctnacncctccacacggccatcgtccttcccccgngccaccctcctcccaagcgccacctcggcggggcnccgacggccggccccgtgggccttcggacccgtggtaccgaacggtacccttacccttccctaacgtacgttcgacccttcgcggtacgggcggggtccgtaggggaccgaaacggggccgacgtaagtaccggngngnnnnnnnnnnnnnnnnnnnnnnn

SEQ ID NO: 399946 - DNA, 642 bp, Homo sapiens
  misc_feature: GZ8MTXP02JBSAG.4.22.B11.1.454.CMB.2.raw
  modified_base (305)..(305): a, c, t, g, unknown or other
tcagagcactgtagcacgaccggtgctcgatttagacgacagctcagggggagctctgggagaggagccccagccgtgagattcccaggagtttccacttggtgatcagcactgaacacagaccaccaaccatggagtttgggcttagcttgggttttccttgttgcttattttcaaaggtgtccaatgtgaggtgcaactgctggagtcgtgggggagcttggtacagccagggcgcctccctgacactctcctgtactaacttcgtggttcattcttgctgattatactttgacctggtcccncaggcctccgaggggaggcgtggagtggtattggtttcagttagaagtactaaaacgttgtgggtacggacacgaagtaatgtcggccgtcgttactggtaaggaaacggcgaagtattaccaaccctatacctaacgaagacgtatacgtaacttaccgaaaagttcgtaccgtaccctaccctaccgaagtatacgtacctacggacctaggaaacgtaccgaagacctacgtaaccgttaccctttaattacgtcgtacgtacgtaagacgtacgtccggtacgttccgggttacccgtttacggtttacgttttcgggaccggttaccccggg

SEQ ID NO: 399947 - DNA, 759 bp, Homo sapiens
  misc_feature: GZ8MTXP02F64XY.4.22.B11.1.454.CMB.2.raw
  modified_base (237)..(237): a, c, t, g, unknown or other
  modified_base (307)..(307): a, c, t, g, unknown or other
tcagagcactgtagcacgaccggtgctcgatttagacgacagctcagggggagctctgggagaggagccccagccgtgagattcccaggagtttccacttggtgatcagcactgaacacagaccaccaaccatggagtttggcttagctgggttttcctgttgctattttcaaaggtgtccaatgtgaggtgcaactgctggagtcgtgggggagtcttggtacagcccgagggccnctccctgacactctctagtacacttcgtggttcattcttgctgtatttattactttgaccgtgggtcccncgaggcctccggaaggggaacggggcgtgggagttgggtagtttggtttacaagtttaagaaagtactaaaaaaccgtttgtacgggggtacgggaaaccaaccgtaaggtaaatacgttccgggccccggtacgttaccgttagggttaagggaaaacgggtacccgtaacggtaactttacccaaccctaacgttaccttaccgaaaagacgtaagtaacgtaactttaaaccgaaaaacgttcggttacccgtacccttaaccccgtaccgtaacgtaacgttacgaaacgttaccgaccgttaacggaaaacgaacccggtaaacggtaaccttacccgtaaccgtttaccctttaaagttaccgttaggttacgtacgtaaggacgtacgtaacgtaccggttccggtacccggttagttacggttttcgggaccggttacccgggg

SEQ ID NO: 399948 - DNA, 779 bp, Homo sapiens
  misc_feature: GZ8MTXP02H6PP3.4.22.B11.1.454.CMB.2.raw
  modified_base (306)..(306): a, c, t, g, unknown or other
tcagagcactgtagcacgaccggtgctcgatttagacgacagctcaggggagctctgggagaggagccccagccgtgagattcccaggagtttccacttggtgatcagcactggaacacagaccaccaaccatggagtttgggcttagctgggttttccttgttgctattttcaaaggtgtccaatgtgaggtgcaactgctggagtcgtgggggagcttggtacagccgagggcgctccctgaccactctcctgtaccaacttctgggttcattctttgctgtattatactttgacctgggtccncaggctcgaggggagggctggagtggtattggttacaagtttaggaaagtactaaaaactttagtaggggtacgggaacctaccgaaagtaaacttgtacgggcccgtacgttccgttagggtaacggaaaacggcgtaagattacccaaccctaacttacctaccgaaaaggtaacgtaagtacgtaaacgtttaccccgaaaaaaggttcggttacccggtaccccttaaacccgttacccgtaaacggtaacgttacggaaacccgttacggaacccgttaacggtaaaacgggaaacccggtaaaacggtaaccgttaacccgtaaacggttacccccgtttttaaactttaaccgttacggtttacgtaccgttaaacggtaaggtacgttaacccgggtaaccgttaccgggttaccccggtttaacggtttaacggttttttcggggacccggtttaccccggggg

SEQ ID NO: 399949 - DNA, 788 bp, Homo sapiens
  misc_feature: GZ8MTXP02JTUI9.4.22.B11.1.454.CMB.2.raw
  modified_base (346)..(346): a, c, t, g, unknown or other
tcagagcactgtagcacgaccggtgctcgatttagacgacagctcaggggagctctgggagaggagccccagccgtgagattcccaggagtttccacttggtgatcagcactgaacacagaccaccaaccatggagtttggcttagcttgggttttccttgttgcttattttcaaaggtgtccaatgtgaggtgacaacgtgcgtgggagttcggtggggggaggtcgttagggtacacggccgaggggccgcctcccctagacctaccttcttcccttagtaacctaactttcgtgggttctattctttgctgtatttacttactttcggaccgttcgggtcccnccgacggtccgtacccggaggggaacggggtcgtaggggtaggttgggtagttttcgggtttactaaagtttaagaaagtaactaaaacccgtttgtacggggtacggaacaccgaagtaactgcgaccgtcgttctagggtaacggaagtcagtacttaccgactacttacacgtaagtagtagtagtaacttaaccgtaaaacggttcgtaccccgtacccttaacccgtactaacggtaccgttaacgtaacccgtaccgtaacccgttaacgggaaaccggtaaacccggaaacgtaacccgtacgttaaacccgtttaccccttttaaagtttaccgtacggttacgtaaccgttagaacgtaccgtaacggtaacggttcccggtttaccggtttaaacgtttcggtttttacgggggacccgtttaaccccgggg

SEQ ID NO: 399950 - DNA, 551 bp, Homo sapiens
  misc_feature: GZ8MTXP01D6CQV.15.30.C08.1.454.CMB.2.raw
  modified_base (377)..(377): a, c, t, g, unknown or other
  modified_base (487)..(487): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctggggggacgcctggtcaagcctggggggtccctgagactctcctgtacagtctctggattcacttcagtagtatggcatgaactgggtccgccaggctccgaggggagggggctggagtgggtctcatccattagtgctggaagtagtacatctactacgcagaactcngtgaggggccattcaccatctcagagacaacgccagggtactcagtgtaactctgacaaataggaacagacctagagagcgacggacgacgcgtgtgtataactgttggngagagagttacgttacgggaccggtaaccggacgaagtggacgttacgtaacgttcggtaaggg

SEQ ID NO: 399951 - DNA, 570 bp, Homo sapiens
  misc_feature: GZ8MTXP01AJYF5.15.30.C08.1.454.CMB.2.raw
  modified_base (352)..(352): a, c, t, g, unknown or other
  modified_base (386)..(386): a, c, t, g, unknown or other
  modified_base (493)..(493): a, c, t, g, unknown or other
  modified_base (500)..(500): a, c, t, g, unknown or other
  modified_base (507)..(507): a, c, t, g, unknown or other
  modified_base (513)..(513): a, c, t, g, unknown or other
  modified_base (519)..(519): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcaccgtggtggagtcgtgggggacgcctggtcaagccgtgggggtccctgagactctcctgtacagtctctggattcaccttcagttagttatggcatgaactgggtccgccgaggctccgaggggagggggctggaggtggtctcgatccagtttagngctggaagtagtacatctactacgcagaactcgngtggacggggccgtattccacatcctccgagacgaacacgaccgagggactcgagttcgtaattccgagacaaagtcggaacagtccaggagacgcgagacgacgtntgtagtnttaacgngttcgngagagnttccgttaggggaccctcggagtaacgcggtacagtaagttcgggtaaggg

SEQ ID NO: 399952 - DNA, 572 bp, Homo sapiens
  misc_feature: GZ8MTXP01D4V4P.15.30.C08.1.454.CMB.2.raw
  modified_base (386)..(386): a, c, t, g, unknown or other
  modified_base (406)..(406): a, c, t, g, unknown or other
  modified_base (429)..(429): a, c, t, g, unknown or other
  modified_base (434)..(434): a, c, t, g, unknown or other
  modified_base (439)..(439): a, c, t, g, unknown or other
  modified_base (441)..(441): a, c, t, g, unknown or other
  modified_base (444)..(444): a, c, t, g, unknown or other
  modified_base (493)..(493): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgccgtggtcaagccgtggggggtccctgagactctcctgtacagtctctggattcaccttcagtagttatggcatgaactgggtccgccgaggctccgaggggaggggcgtggagtcggtacgtcatccagtttagtgctggaagtagttacatctactacgcagactcnggtgaggggccatcacatcncagacacaacgtcgagggacctnagttnatcananaanagaacacgacgagagacgacgacgacgacgtgtagtagttagtaagtgnggacggaggagtacgttacggttaccgggttaccggtaaccggagaacgtcggtacgttacgtaacgttcgggtaaggg

SEQ ID NO: 399953 - DNA, 557 bp, Homo sapiens
  misc_feature: GZ8MTXP01BV3KS.15.30.C08.1.454.CMB.2.raw
  modified_base (257)..(257): a, c, t, g, unknown or other
  modified_base (284)..(284): a, c, t, g, unknown or other
  modified_base (381)..(381): a, c, t, g, unknown or other
  modified_base (400)..(400): a, c, t, g, unknown or other
  modified_base (468)..(468): a, c, t, g, unknown or other
  modified_base (473)..(473): a, c, t, g, unknown or other
  modified_base (488)..(488): a, c, t, g, unknown or other
  modified_base (525)..(525): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtgggggtccctgagactctcctgtacngtctctggattcaccttcagtagttanggcatgaactgggtccgcaggcctcgaggggagggggctggagtgggtctcatccattagtgcgtggaagtagtacagtctactacgcagaactcgngtggacggggccattcacntctacagagacacgccgaggactcgagtgtatctgacaaagtgaaacagcctagacgagccgaggacncggtntgtagtataacgtgngacgagtacgagttcggttacggggccctaaccgggngaagttgggcttaacgaagttcgggtaagggg

SEQ ID NO: 399954 - DNA, 584 bp, Homo sapiens
  misc_feature: GZ8MTXP01BW164.15.30.C08.1.454.CMB.2.raw
  modified_base (285)..(285): a, c, t, g, unknown or other
  modified_base (303)..(303): a, c, t, g, unknown or other
  modified_base (320)..(320): a, c, t, g, unknown or other
  modified_base (394)..(394): a, c, t, g, unknown or other
  modified_base (456)..(456): a, c, t, g, unknown or other
  modified_base (509)..(509): a, c, t, g, unknown or other
  modified_base (522)..(522): a, c, t, g, unknown or other
  modified_base (528)..(528): a, c, t, g, unknown or other
  modified_base (532)..(532): a, c, t, g, unknown or other
  modified_base (552)..(552): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgactggtcaagccgtggggggtccctgagactctcctgtacagtctctggattccacttcagtagttanggcatgaacgtgggtccnccaggcctccgaggggngggggctggaggtcgggtctcgatccagtttaggtgcgtaggaagtagttacagttctactacgcagaacctcngtggaggggcccattccgaccatcctaccagacgacgaacgccgaagggactcgaagtgtanctagacaaagtggaaacagcctagacgacgccggagaccgcggtctgtacgtnttaacgtggttgngttagngtancgggttcgggccctaacggngaagtcgggacttacgtaagttcggtaagggg

SEQ ID NO: 399955 - DNA, 597 bp, Homo sapiens
  misc_feature: GZ8MTXP01AEDQH.15.30.C08.1.454.CMB.2.raw
  modified_base (468)..(468): a, c, t, g, unknown or other
  modified_base (475)..(475): a, c, t, g, unknown or other
  modified_base (482)..(482): a, c, t, g, unknown or other
  modified_base (491)..(491): a, c, t, g, unknown or other
  modified_base (505)..(505): a, c, t, g, unknown or other
  modified_base (516)..(516): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgccgtggtcaaggccgtggggggtccctggagactctcctgtacagtctctggattcaccttcagtagttatggcatgaacgtggggtcccgccgaggcctccgagggggagggggctgggaggtggggtctcgatcctatttagtgctagggaagtagttacattctaactacgcagaactcgaaggtgggacgggggcctattccacctatcctaccgagaacgacaaccgccgagggactgagtgatcngacaaanggaaacngccagacgngcgaggacacggtntgtgtattcgngttcgacgagacgtagttcggacggggttacccctaaccgggagtaacgtcgggcttaacgtaaggttcgggttaaggggg

SEQ ID NO: 399956 - DNA, 575 bp, Homo sapiens
  misc_feature: GZ8MTXP01E31NX.15.30.C08.1.454.CMB.2.raw
  modified_base (255)..(255): a, c, t, g, unknown or other
  modified_base (272)..(272): a, c, t, g, unknown or other
  modified_base (345)..(345): a, c, t, g, unknown or other
  modified_base (399)..(399): a, c, t, g, unknown or other
  modified_base (505)..(505): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactgggctccgctgggttttccttgtgctattttagaaggtgtccagtgtgaggagcacctggtggagtcgtggggacgcctggtcaagccgtggggggtccctgagactctcctgtacngtctctgattcaccttnagtagtatggcatgaactgggtccgccgaggctccgagggggaggggctggaggtggtctacatccatttagngctaggaagtagttacactctactacgcagaactcaagtggagggcctatcacntccacagacacaacgtccgaagggtacctgagtcgtaatccgagacaaaataacggaacacgaccgagagacgacgacgacgacgtacgtagtgtattaagtaggngagagagtacgttacggttacgggaccggtaaccggagaagtacgtacgacgtaacgttaacggtaaggg

SEQ ID NO: 399957 - DNA, 661 bp, Homo sapiens
  misc_feature: GZ8MTXP01DY0M1.15.30.C08.1.454.CMB.2.raw
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtgggggtccctgagactctcctgtacagtctctggattcaccttcagtagttatggcatgaacgtgggtccgccgaggcctccgagggggagggggctggagtcgggtctcatcctagtttagtgacgtggtaagtagttacactcctactacgcacgaactcgaacgggttggacgggggtaccctacttaccaccagttcccaccgaagaacgacccaaacggtccccgagggaacctcgagttcgacttccgaagtaacaaaagttcggggaaacaggtacccgaggaacggacggcccggaaggaaccacggtcttaggtcgttaattaacgttggaggacggttagaacgtacttacggggttcggggttaccccgtaaccgggagtaacgtaggtacgaacctaaggtttccggggttaaggggg

SEQ ID NO: 399958 - DNA, 578 bp, Homo sapiens
  misc_feature: GZ8MTXP01DEY8D.15.30.C08.1.454.CMB.2.raw
  modified_base (277)..(277): a, c, t, g, unknown or other
  modified_base (303)..(303): a, c, t, g, unknown or other
  modified_base (348)..(348): a, c, t, g, unknown or other
  modified_base (407)..(407): a, c, t, g, unknown or other
  modified_base (454)..(454): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtggggggacgcctggtcaagccgtggggggtccctgagactctcctgtacagtctctggattcaccttnagtagttatggcatgaactgggtccnccgaggctcgaggggagggggctggagtgggtctcatccattagngctaggaagtagtacactctactacgcagaactcaaggtggacggggccattccactanctccagagacaacgccagggactcgagtgatctgactaaatggaacngacctgagacgccggagacgacggtctagtagttattaacgtggttggacgaggagtattacgggttacggggccctaacccgggagtaactcgggacttaacgtaagttccgggttaaggggg

SEQ ID NO: 399959 - DNA, 663 bp, Homo sapiens
  misc_feature: GZ8MTXP01AZI1M.15.30.C08.1.454.CMB.2.raw
  modified_base (257)..(257): a, c, t, g, unknown or other
  modified_base (301)..(301): a, c, t, g, unknown or other
  modified_base (382)..(382): a, c, t, g, unknown or other
  modified_base (411)..(411): a, c, t, g, unknown or other
  modified_base (496)..(496): a, c, t, g, unknown or other
  modified_base (501)..(501): a, c, t, g, unknown or other
tcagtctacgtagccacgaccggtgctcgatttagtctgacgtcaaagggaaaggggagagaggagccctagccctggattccaaggcctctccacttggtgatcagcactgagcaccgaggattcaccatggaactggggctccgctgggttttccttgttgcttattttagaaggtgtccagtgtgaggagcacctggtggagtcgtggggacgccgtggtcaagccgtgggggtccctgagactctcctgtacngtctctgattcaccttcagtagttatggcatagacgtcggtccncgaggtccgtcggagggggagggcgtggaggtgggtctacacgtcctaagtttacggtgtacgtaggtaagttacgttacncgttactacgtacgacgagtaaccgtagnggtacggggaccggggtaccgtacttccaaccgtattacccgaccgaagaacgaaccgaacgtacgacgggtactcgtaaggttntacgntaagaactaagacggacgtacgacgtagacgaccggacggacggaccgtacgtgtagttacgttacgtcgtggacgaggaacgtacgttacggttacggggttcccggttacccggtaacggagtaacggtacgtaacgttaacggtgggttcggggtaagg

SEQ ID NO: 399960 - DNA, 822 bp, Homo sapiens
  misc_feature: GZ8MTXP01EALCT.15.30.C08.1.454.CMB.2.raw
  modified_base (276)..(276): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactgggctccgctgggttttccttgttgctattttagaggtgtccagtgtgaggagcaccgtggtggagtcgtgggggacgccgtggtcaagccggtgggggtccctgagactctcctgtacagtctctggattcaccttnagtagttatggcagtagaacgtgggtcccgccgaggtcctccggagggggacggggcgtagggaggttcggggtctacactaccgagtttaaggtgtacgttaggaaagttacgtttaacacttaccgtaacgtaccggtacaacggaaaccgttacgaaggggttacgggaacgggggtacccgtacgtttacccaacccgtaacgttaccctacccgaaaggaaccggaaacccaaacgggcccccgggttaaaagggggtaacccttccggtaaagggtttccggttaaaattcccgtaagggaaccttaaaaacggttgggggaaaaaaccccgtcgggtaacccgtaaaggaaccggggaaccggttaccgggaaacggtaaacccgggtcggttacggttacggtttaacgttaaacggtttaacggtgggaacgggtaacgagggtaaacggttacggttaccgggggttacccgggttaccccgtaacgggagtcgtaacgggtaccttaaacggttaacgggttcggggtaacgggg

SEQ ID NO: 399961 - DNA, 635 bp, Homo sapiens
  misc_feature: GZ8MTXP01A28OK.15.30.C08.1.454.CMB.2.raw
  modified_base (219)..(219): a, c, t, g, unknown or other
  modified_base (291)..(291): a, c, t, g, unknown or other
  modified_base (396)..(396): a, c, t, g, unknown or other
  modified_base (408)..(408): a, c, t, g, unknown or other
  modified_base (431)..(431): a, c, t, g, unknown or other
  modified_base (447)..(447): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgcttattttagaaggtgtccagtgtgaggagcaccgtggtggagtcgtgggggacncctggtcaagccgtggggggtccctggagactctcctgtacagtctctggacttccaccttcagttagttanggcatgaactgggtccgccgaggcctcggaggggaggggctgggagtggggtctcgtactcctaattggtgtcgtaggaagttacgtactactactaacgtcganacgaacttacgnggtgggacggggtcctatcactntcacagacgacgaacnccggaggtaccntacgtntacttacanactaaagacggacgacgacgacgacggacgaccggaacggacggaccgtagttgttacgtacgttaacgttgttaggacgacggtaagacggttacggttaccgggttacccggtaaccggacggaagtcgtacgttacgtaacggttcgggttaaggggg

SEQ ID NO: 399962 - DNA, 657 bp, Homo sapiens
  misc_feature: GZ8MTXP01DAW6I.15.30.C08.1.454.CMB.2.raw
  modified_base (388)..(388): a, c, t, g, unknown or other
  modified_base (470)..(470): a, c, t, g, unknown or other
  modified_base (544)..(544): a, c, t, g, unknown or other
  modified_base (590)..(590): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactgggctcgcttgggttttccttgttgcttattttagaaggtgtccagtgtgaggagcaccgtggtggagtcggtggggacgccgtggtacaaggccggttcggggggtccctgacgactcctctgtacagttctgtgtacttccaccttcgagttagttagtggcagtagtaacgtcgggtacccgccgaggccgtaccggagggggacggggcggtaggtaggtcgggtacctcgacgtacgtagtttgngtcgtaggtaagttacttactaccttacgtaacgtacgacgaacgtaactcgaagggttcggacggggtctaactcaacctnttccacagaacgaaccgacgtaccgacggatacggtatcgacttagacgaactaagtacgacgtagccgaaggnggacccgaggacgttaaaccgccggtgttagtcttaaggttgtagnggacgaaggagtccttaggggttccggaaccggtcggattccggagtcaagtccgttaagggtaacg

SEQ ID NO: 399963 - DNA, 657 bp, Homo sapiens
  misc_feature: GZ8MTXP01CI7A9.15.30.C08.1.454.CMB.2.raw
  modified_base (293)..(293): a, c, t, g, unknown or other
  modified_base (315)..(315): a, c, t, g, unknown or other
  modified_base (371)..(371): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcaccgtggtggagtcgtgggggacgccgtggtcaagccgtgggggtccctgagtactctcctgtacagtctcgtggtacttccaccttcaggttagttanggacagtgaacgtcgggtcccnccgaggcctacggagggggacggggcgtggaggtgggtctcactccgtagtttagngtcgtaggaagttcgtacacttactacgtacgacagaacctcgaagggtcgggaacggggcctagttccaacctatccgtaccaagaacgaaccaaccggccaaggggtacctacgtagttcgtaactcgtacgaaactaaaacgtcgggaaacgttacggccccgtagggaaaccgacggtacccggaagacccggagtcgttgtacgttagttaacgtggcgacgagtacgcttacgggttacgggccgtaacgagtcgtggacttacgtaagttgggtaacgg

SEQ ID NO: 399964 - DNA, 577 bp, Homo sapiens
  misc_feature: GZ8MTXP02HOMA8.15.30.C08.1.454.CMB.2.raw
  modified_base (300)..(300): a, c, t, g, unknown or other
  modified_base (377)..(377): a, c, t, g, unknown or other
  modified_base (450)..(450): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagcctggggggtccctgagactctcctgtacagtctctggattcaccttcagtagttatggcatgaactgggtccnccaggctccgaggggaggggctggagtgggtctcatccatttagtgctggaagtagttacatctactacgcagactnaggtgagggggccattccaccatcctaccagagacaacgccaggggactcgagtgtatctgacaaatgaaacngcctagagacgccggaggacgacggtctagtgtaacttactggtgcggtagagacgtaccggttacgggggacccttaacccggggagtacgtacgggactaaccgtaagtttccgggttaaggggg

SEQ ID NO: 399965 - DNA, 651 bp, Homo sapiens
  misc_feature: GZ8MTXP02JYSO7.15.30.C08.1.454.CMB.2.raw
  modified_base (574)..(574): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaaggccgtggggggtccctgagactctcctgtacagtctctggattcaccttcagttagttatggcatgaacgtgggtcccgccgaggcctccggaggggaggggcgtgggaggtgggtctcatccagttaggtgcgtaggtaagttacgttacacgtactacgtacgcagactcgaggtgggacgggggcctattccgaacctattccctacccgaaggaaccgaaccgaaccggacccgaaggggtacctacgaaggttcgttaactccgtagaactaaaagtacgaaactacgaccgtaggaggaccggaccggaaggaccgacggtcttggttacgtactttacgnggtacgacggaagtacgtacgtccggtacggggccctaacgggagtacgtcggactaacggacgtttcgggtagggg

SEQ ID NO: 399966 - DNA, 561 bp, Homo sapiens
  misc_feature: GZ8MTXP02JES2X.15.30.C08.1.454.CMB.2.raw
  modified_base (413)..(413): a, c, t, g, unknown or other
  modified_base (437)..(437): a, c, t, g, unknown or other
  modified_base (441)..(441): a, c, t, g, unknown or other
  modified_base (443)..(443): a, c, t, g, unknown or other
  modified_base (446)..(446): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtgggggtccctgagactctcctgtacagtctctggattcaccttcagtagttatggcatgaactggtccgccaggctccgaggggaggggcgtggaggtcgggtacgtcgatcctaagttagtgctaggaagtagttacaatctactacgcagactcagtgaggggccatcaccatcacaganacaaacgcagggtactcgaaggtnatcnanaanagaacacgacgtagagacgacgacgacgacgacgtagtagtattacgtgtgacgagacgacgtacgtacggaccggtaaccggacgacgtacgacgtacgtaacgtacggtaggg

SEQ ID NO: 399967 - DNA, 559 bp, Homo sapiens
  misc_feature: GZ8MTXP02FM3OM.15.30.C08.1.454.CMB.2.raw
  modified_base (435)..(435): a, c, t, g, unknown or other
  modified_base (439)..(439): a, c, t, g, unknown or other
  modified_base (441)..(441): a, c, t, g, unknown or other
  modified_base (444)..(444): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagcctggggggtccctgagactctcctgtacagtctctggattcaccttcagtagttatggcatgaactgggtccgccaggctccgaggggaggggcgtcggaggtgggtactcgatccagttagtgctggaagtagtacatctactacgcagactcagtgaggggccgattcacatctcagacgaacaacgccaggggactcaagtgtancgananaanagacagacgagagacgacgacgacgacggcgtgtagtagttacgtgtggacgagacgacgtacgtacgggaccgtaaccggacgacgtacggacgtaacgtacgtacggtacggg

SEQ ID NO: 399968 - DNA, 603 bp, Homo sapiens
  misc_feature: GZ8MTXP02I0K9Y.15.30.C08.1.454.CMB.2.raw
  modified_base (381)..(381): a, c, t, g, unknown or other
  modified_base (460)..(460): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagcctgggggtccctgagactctcctgtacagtctctggattcaccttcagtagttatggcatgaactgggtccgccaggcctccgaggggaggggcgtgggaggtgggtctcatccattagtgcgtggaagtagtacatctactacgacagactcngtggacggggccgtattccacactcctaccagacgaaccaacgccagggactcgagtgtatctagactaaatcgaaacngccctagggaacgacggacccggaaagggtaccctaacgggctttaggtacgttaacttacgtggtagacggaaagaggtactacggtaacgggggccctaaacccgggagtacgtacggactaacgaagttcggtaaggggg

SEQ ID NO: 399969 - DNA, 616 bp, Homo sapiens
  misc_feature: GZ8MTXP02JF6EU.15.30.C08.1.454.CMB.2.raw
  modified_base (470)..(470): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtgggggtccctgagactctcctgtacagtctctggattcaccttcagtagttatggcatgaactgggtccgccgaggcctccgaggggaggggcgtgggaggtgggtctcatcctagttagtgcgtggaagtagttacatcctactacgcagacctcgaggtggacgggggccagttcaccatctaccagacgacaacgccgagggactcgaagtgtatcgtagacaaaagtgaaaaccncgacgtaggacgaccggacggaacggacgacggtgttaggtagttaatttacggtggtacggacggaaggacgtacgtaccgggtaacggggtacccgtaaccgggagtaacggtcggacctaacggtaacggttcgggtaagggg

SEQ ID NO: 399970 - DNA, 568 bp, Homo sapiens
  misc_feature: GZ8MTXP02I56K8.15.30.C08.1.454.CMB.2.raw
  modified_base (301)..(301): a, c, t, g, unknown or other
  modified_base (348)..(348): a, c, t, g, unknown or other
  modified_base (438)..(438): a, c, t, g, unknown or other
  modified_base (481)..(481): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagccgtggggggtccctgagactctcctgtacagtctctggattcaccttcagtagttatggcatgaactgggtccnccaggctccgaggggaggggctgggaggtgggtctcatccatttagngctggaagtagttacatctactacgcagactcgaggtgacgggggccagttccacatcctccagacgacaacgcagggactcgagtgtanctgacaaatgaacagcctgacgacgccgaggactacggcttgngttaattacgtgtacgcgaagagtacgtaccggacggggtccctaaccggagtacgtcggacctaacgaacgttcgggttaaggggg

SEQ ID NO: 399971 - DNA, 588 bp, Homo sapiens
  misc_feature: GZ8MTXP02GZAYN.15.30.C08.1.454.CMB.2.raw
  modified_base (383)..(383): a, c, t, g, unknown or other
  modified_base (509)..(509): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagccgtggggggtccctgagactctcctgtacagtctctggattcaccttcagtagttatggcatgaactgggtccgccaggctccgagggggaggggcgtggaggtggggtctcatccagttagtgctaggaagtagttacactctactacgcagctngtggacggggccattccaacctatcctccgaagacaccaacgccgaggggactcgagtgtatctgaacaaatgaaactagcctagggaacgacgacggtaggacgacggctgtagtaactttacgnggtgacggagaggtactccgggtacggggacccgtaaccgggagtacgttcggactaaacgacggttcgggtaaggggg

SEQ ID NO: 399972 - DNA, 691 bp, Homo sapiens
  misc_feature: GZ8MTXP02II9W7.15.30.C08.1.454.CMB.2.raw
  modified_base (217)..(217): a, c, t, g, unknown or other
  modified_base (303)..(303): a, c, t, g, unknown or other
  modified_base (492)..(492): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacnccgtggtcaagccgtgggggtccctgagactctctgtacagtctctggattcaccttcagtagttatggcatgaacgtgggtcccnccgaggcctaccggaggggaggggcgtgggaggtggggtcctgactcctagttaggtgcgtagggtaagtagtacactaccgtacgtacgtacgagacctcgtaggtgggacgggggccggtacttaccgaaccctatcctacccgagaaccgaccgaaaccggccgaacggggtactcgagttacgtnacgtagactaaactaggaacacgtacgtaggacgaacggaccgtaacgggacgaaccgggtcgtagttaccgttaactttaagttcggtggaccgggtaagaaggttaccgtacggttacccgggggaacccggaaccccggttaaggtacgttacggggacctttaaaacggtaacggttccggggtttaacgggggg

SEQ ID NO: 399973 - DNA, 555 bp, Homo sapiens
  misc_feature: GZ8MTXP02JHARM.15.30.C08.1.454.CMB.2.raw
  modified_base (443)..(443): a, c, t, g, unknown or other
  modified_base (473)..(473): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtctgggggacgcctggtcaagcctgggggtccctgagactctctgtacagtctctggattcaccttcagtagttatggcatgaactgggtccgccaggctccgaggggaggggctgggagtggggtctcatccattagtgctaggaagtagttacatctactacgcagactcagtgaggggcgattcaccatcctacagacgacacgtcagggctcgagtgtatctgacaaatgaacngcctgagagccgagacagctgtgtattacngttcgagtagagaacgttcgaacggggacccttaaccggggagtacgtacgggtaccaacgtaacgttcggtttaacggggg

SEQ ID NO: 399974 - DNA, 637 bp, Homo sapiens
  misc_feature: GZ8MTXP02IKRNC.15.30.C08.1.454.CMB.2.raw
  modified_base (283)..(283): a, c, t, g, unknown or other
  modified_base (400)..(400): a, c, t, g, unknown or other
  modified_base (487)..(487): a, c, t, g, unknown or other
  modified_base (501)..(501): a, c, t, g, unknown or other
  modified_base (507)..(507): a, c, t, g, unknown or other
  modified_base (558)..(558): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtgggggtccctgagactctcctgacagtctctggattcaccttcagtagttanggcatgaacgtcggggtcccgccgaggcctccggagggggacggggcgtgggaggtgggtcctcactcctagttagtgcgtaggaagttagttacactctactacgcacgacctcgnggtcgggacgggggtcccgtacttaccgaactatccctaccgagacgaaccgaaccggcgaggggactcgagttcgtatctacgganaaaagtgaaaccgngtaccngggaaagcggaccggaggtacccgaggtcttagtagtttactacgttaggnggacggtaagacgtacgttacggtacgggggccctaaccgggagacgttcggacctacgtaaggttccgggtaaggggg

SEQ ID NO: 399975 - DNA, 586 bp, Homo sapiens
  misc_feature: GZ8MTXP02FG67Z.15.30.C08.1.454.CMB.2.raw
  modified_base (285)..(285): a, c, t, g, unknown or other
  modified_base (302)..(302): a, c, t, g, unknown or other
  modified_base (335)..(335): a, c, t, g, unknown or other
  modified_base (344)..(344): a, c, t, g, unknown or other
  modified_base (518)..(518): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtggggggtccctgagactctcctgtacagtctctggattcaccttcagtagttanggcatgaactgggtccncaggctcgaggggaggggctggagtgggtctcntccattagngctggaagttagtacactctaactacgcagactcaggtggacgggggtcagttccaccgtaactctacccaagaacggaacaaaccggtcccaaggggaacctcgaaggtgtatccgtgtaacaaatgaacagcctagagacgaccgaggacctacggctagtgtaacttacgngtcggacgagtacggattcggacgggaccctaaccgggatacgtcggctaaacacgtcggttaagggg

SEQ ID NO: 399976 - DNA, 557 bp, Homo sapiens
  misc_feature: GZ8MTXP02IPE0J.15.30.C08.1.454.CMB.2.raw
  modified_base (392)..(392): a, c, t, g, unknown or other
  modified_base (395)..(395): a, c, t, g, unknown or other
  modified_base (414)..(414): a, c, t, g, unknown or other
  modified_base (441)..(441): a, c, t, g, unknown or other
  modified_base (479)..(479): a, c, t, g, unknown or other
  modified_base (523)..(523): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactgggctccgctgggttttccttgttgctattttagaaggtgtccagtgtgaggagcacctggtggagtctgggggacgcctggtcaagcctgggggtccctgagactctcctgtacagtctctggattcaccttcagtagttatggcatgaactgggtccgccaggctccgagggaggggctggagtgggtctgatccagttagtgctggaagtagttacatcctactacgcagactcagtgacggggcatcacntcncagagacaacgcagggacncgaagtcgtatcagacaaaatgaaacngcctgagacgcgaggacacggactgtagtactttacgngtagacgtaagagacgtaccgttacgggggcccttaaccggggngtacgtacgggtactacaagtttcggtaaggggg

SEQ ID NO: 399977 - DNA, 595 bp, Homo sapiens
  misc_feature: GZ8MTXP02I8TAF.15.30.C08.1.454.CMB.2.raw
  modified_base (273)..(273): a, c, t, g, unknown or other
  modified_base (299)..(299): a, c, t, g, unknown or other
  modified_base (317)..(317): a, c, t, g, unknown or other
  modified_base (344)..(344): a, c, t, g, unknown or other
  modified_base (363)..(363): a, c, t, g, unknown or other
  modified_base (474)..(474): a, c, t, g, unknown or other
  modified_base (478)..(478): a, c, t, g, unknown or other
  modified_base (489)..(489): a, c, t, g, unknown or other
  modified_base (524)..(524): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgagattcaccatggaactgggctccgctgggttttccttgttgctattttagaaggtgtccagtgtgaggagcacctggtggagtcgtgggggacgcctggtcaagccgtgggggtccctgagactctcctgtacagtctctggattcaccttnagttagttatggcatgacgtggtccnccgaggcctcggaggggngggctgggagtggtctcatctattagngcgtaggtaagtagttacntacctacgtacgactagtaacctgtaggtcgggacgggggtcctacgttccaccgtattacccgaccgaagaacgaaccgaaccgccgaagggacctacgagttgtatcgngaanaacgtagaacngtccaggagacgcggtagcagctagtatattacgnggtagacgagacgtcgtaccggtaccggaccgtaaccggagtacggtcgacttaccgagttcggtaaaggg

SEQ ID NO: 399978 - DNA, 683 bp, Homo sapiens
  misc_feature: GZ8MTXP02F17BK.15.30.C08.1.454.CMB.2.raw
  modified_base (389)..(389): a, c, t, g, unknown or other
  modified_base (682)..(683): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcacctggtggagtcgtgggggacgcctggtcaagccgtgggggtccctgagactctcctgtacagtctctggattccaccttcagttagttatggcatgaacgtcgggtccgccgaggcctccgaggggacgggcgggtggtaggtcggtacggcgacgtacgtacgtagtgctgagtagtacactcgtactacgnagacctagcggtggacggggtccgtagttacccactaccttccaacccgtaaggacaaaccgaccggtaccgtaaaaggggacccttcgaacgttggtaccgtacttaacgaaacgtaaacgtaaacgtaaccgtacgtaccggtaacggaacggaaccggaaccgggaaccggacggtacggttacggttacggttacggtttaacggttaacggttacggtacggtaacgggtaaacggtaacggtaccgggtaaccgggtaacccggggtaacccggggtaacccgggtnn

SEQ ID NO: 399979 - DNA, 649 bp, Homo sapiens
  misc_feature: GZ8MTXP02GB7TX.15.30.C08.1.454.CMB.2.raw
  modified_base (259)..(259): a, c, t, g, unknown or other
  modified_base (286)..(286): a, c, t, g, unknown or other
  modified_base (481)..(481): a, c, t, g, unknown or other
  modified_base (488)..(488): a, c, t, g, unknown or other
  modified_base (505)..(505): a, c, t, g, unknown or other
  modified_base (544)..(544): a, c, t, g, unknown or other
tcagtctacgtagccacgaccggtgctcgatttagtctgacgtcaaagggaaagggggagagaggagccttagccctggattccaaggcctctccacttggtgatcagcactgagcaccgaggattcaccatggaactggggctccgctgggttttccttgttgctattttagaaggtgtccagtgtgaggagcaccgtggtggagtcgtgggggacgccgtggtcaagccgtgggggtccctgagactctcctgtacngtctctggattcaccttcagtagttanggcatgaacgtcggtccgccgaggcctccggaggggaggggcgtgggaggtgggtcctcgatccagttagtgtcgtaggaagttaacgtacacgttacctactacgacctaaggaccttcgagggtgggacgggtaccgtacttaccgaacctacgtaccctacgaagtaaccgaacgacgaccgtaagggaccngtaggtntatcagaactaaacganaacgagtccaggaagaccgacggaacgtacgaacggttntagttacgttacgtacgttggacgtaagaggtaacgtacggtacccgggtacggaccgtaacggagtacggtacgtaactaaacgttacgggtacggtaacgggg

SEQ ID NO: 399980 - DNA, 609 bp, Homo sapiens
  misc_feature: GZ8MTXP01BTEB3.10.83.H06.1.454.CMB.2.raw
  modified_base (307)..(307): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttggcttagctgggttttcctgttgctatttaaaggtgtcaatgtgaggtgcagttggtggagtcgtgggggagcttggttcagccgagggccggtccctgagactctcttgtacagcctgtggtattttagggtttcgtgattatgctatgagtcgtggttccggnagggctccgaggggagggctgggagtgggtagtttcagttagagcatacgcctagtggggtggggtcttacgagtaactcccggccgtcggtctaggtagaaacgggtcccgtattccacctatctacgaaagacgaacgaactacccgaaaacgccctacgaccctaccgtaggggaaactcggaacacgtaccaagaaacgcgaacgacgacgacggcgtctaattagttggtgttaggacgggaccagttcgacgtaatacgcgtaggttaccgttagggaacggggttaacgtaacgg

SEQ ID NO: 399981 - DNA, 665 bp, Homo sapiens
  misc_feature: GZ8MTXP01BY08A.10.83.H06.1.454.CMB.2.raw
  modified_base (314)..(314): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagttggtggagtcgttgggggagcttggttcagccgaggggccgtccctgacgactctcttgtacagtccctgtggtatttaggttcgtgattatgctatggagtcgtggttcccggnaggctcgagggggaagggctgggagttgggttagtttcagttagagctatacgcctagtgggtgggtcttacgagtaacgtcccgcgtcgtcgtgtaggaaacggtcccgatttccgacctatctacgaagacgaacgactaccccgaaagtcccctacgtaccctacgtagggggtaaactcggggaaccagtacccgtaaggaaaacgtccgaaaccgactaacggaggtccgttacttaagtttcgttagggttacgttaagggaccgggtaaccttacggttcgaccgtaagttacggaacgtacggtttacccggaaggggtaacgggggttaacgttaacccggg

SEQ ID NO: 399982 - DNA, 565 bp, Homo sapiens
  misc_feature: GZ8MTXP01ACVUT.10.83.H06.1.454.CMB.2.raw
  modified_base (179)..(179): a, c, t, g, unknown or other
  modified_base (305)..(305): a, c, t, g, unknown or other
  modified_base (508)..(508): a, c, t, g, unknown or other
  modified_base (531)..(531): a, c, t, g, unknown or other
  modified_base (558)..(558): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttcctgttgctattttaaaggngtccaatgtgaggtgcagttggtggagtctggggggagcttggttcagccaggggcggtccctgagactctcttgtacagcctctggtatttaggtttcgtgattatgctatgagctggttccggnaggctccgaggggagggctgggagtgggtaggtttcattagaagcatacgcctagtgggtggggcttacgagtaactcccggccgtcgtctgggtagaaacgggcccgattcaccatctacaagagacgactacccaaaacgcctacgacctacgaggggaaactggacacgacctagaaacgcgaacgactacgaggccgtntaattattgtgttaggacggacngttcgcgaatagcagtcaggtaagggngtaacgg

SEQ ID NO: 399983 - DNA, 711 bp, Homo sapiens
  misc_feature: GZ8MTXP01EIUV0.10.83.H06.1.454.CMB.2.raw
  modified_base (260)..(260): a, c, t, g, unknown or other
  modified_base (282)..(282): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttggcttagctgggttttccttgttgctatttaaagtgtcaatgtgaggtgcagttggtggagtcgtgggggagtcgttggttcagccgaggggcgtccctgagactctcttgacagcctntggtatttaggtttctgattangtctagtggagtcgtgggttcccggcagggccgtaccggaagggggaacgggggtcttagggggtaaggttgggggtttaaggttttcaagtttaggaaagtcaagttacgccgttagtggggtcgggcttacgagtaacgtcccgccgtcgtctgtagaaacggccgtattcaccatctacgaaagacgacgtaactaaccccgaaaacgtccctaccgtacccgtaaccgtagggggtaaaacttgggaaccacggaaccgtaacgggaaaacggaccggaaacgaacgaaccgtaacgggtcccgttagttaagttttaagttgggttgtttaaacgggaacggggtaacccttaagttccgacggtaacgtacggtaaccgtaaggtttacccggttagggtaacgggggttaacgttaaccggg

SEQ ID NO: 399984 - DNA, 613 bp, Homo sapiens
  misc_feature: GZ8MTXP01BGE6P.10.83.H06.1.454.CMB.2.raw
  modified_base (267)..(267): a, c, t, g, unknown or other
  modified_base (289)..(289): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagttggtggagtcgtgggggagtcttggttcagccgagggcgtccctgagtactctcttgacagcctntggtatttaggttcgtgattangtctatgagcgtggttccggcgaggctccgagggggagggctgggagtgggtagtttcagttagaagcagtacgcctagtggtgggcttacgagtaactcccgccgtcgtcgtagtacggaaacgtccgtattccgacctatctacgaaggaacgaaccgacctaaccccgaaaacgtccctaccgtacctaccgtaggggaaactgggaacacggtaccaaggaaaacgccgaaacgaccgacgacggtcgttactaatttagttggtagttaggacggaccagttcgacgtaatgctacgttcgaggtaacgggcgtaacgg

SEQ ID NO: 399985 - DNA, 539 bp, Homo sapiens
  misc_feature: GZ8MTXP02GUJ4M.10.83.H06.1.454.CMB.2.raw
  modified_base (286)..(286): a, c, t, g, unknown or other
  modified_base (303)..(303): a, c, t, g, unknown or other
  modified_base (322)..(322): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcagttggtggagtcgtgggggagcttggttcagccagggcggtccctgagactctcttgtacagcctctggtattttaggttcgtgattangctatgagctggtccgnaggctcgagggaggctggngtgggtagttcattagaagcatacgctatgggtgggcttgaagatccgcgcgtctgtagaaagcccgattcacatctacaagagacgatacccaaaagccctacgacctaccgtaggaaataggacagacctagaaaagcgacgacacgaggctactattagttgtgttagacggacgaatcgacgaagtagctagtccgtaggaggggacgtacgg

SEQ ID NO: 399986 - DNA, 736 bp, Homo sapiens
  misc_feature: GZ8MTXP02IJ57B.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagttggtggagtcgtgggggaggcttggttcagccgagggcggtccctgagactctcttgtacagcctctggtatttaggttcgtgtattatgctatgagcgttggttccggcagggcctccggaagggggaaggggcgttaggggaggttggggttaggttttcgaagtttaaggaagctaagtacgccttagtggggtggggctttcgaagtacgtcccgggccgtcggttcgttagggtacggaaaacggtcccgtaacgtttacccaccctaacttccgttaacgaaaggaacgaaccggtaacctaacccccgaaaaacgtcccctaccgaccccttaaccgtacgggaaaacgttaggaaccacggaccgtaaggaaaaacgaccggaaaccgaacaaccggacggtacgttacttaacgtttaagtttggttaggtttaaacgggaacggggtaaccctaacggttaccggacgtaacgttaacggaccgttaacggttacccggtaagggtaacgggggtaacgtaaccggg

SEQ ID NO: 399987 - DNA, 557 bp, Homo sapiens
  misc_feature: GZ8MTXP02HA2QH.10.83.H06.1.454.CMB.2.raw
  modified_base (304)..(304): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggagcttggttcagccagggcggtccctgagactctcttgtacagcctctggatttaggttcgtgattatgctatgagctggttccggnaggctccgaggggagggctgggagtgggtaggttcattagagcatacgcctagtgggtggggcttcgagactccgcgcgtctgtagaaagccgattcaccatctacaagagacgactacccaaaagccctacgacctaccgtaggaaacgtggacagacctagaaaacgcgaacgacacgaggcgtactattagttgtgttaggacgggtaccacgtcgacgaagtagctacgttccgaggaggggagtacgg

SEQ ID NO: 399988 - DNA, 679 bp, Homo sapiens
  misc_feature: GZ8MTXP02GEPUE.10.83.H06.1.454.CMB.2.raw
  modified_base (287)..(287): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagttggtggagtcgtgggggagcttggttcagccagggcggtccctgagactctcttgtacagcctctggtattttaggtttcgtgatttangctatgagctggttccggcaggctccgaggggagggctggagtgggtagttcattagagcatacgcctagtgggtggggtcttcgagtacgtcccgccggtcgttccgtggtaggaaaacgggtcccgtatttaccaaccctataccgtaccaaaggacggaaccgtaacgtaacccccgaaaaacgtccccgtaccgtacccgttaaacccgttagggaaaacttgggaacctacggacccgtaaaggaaaacggaccggaacgaaccgaacgacgggtacgttacttaacgtttagtttaggtacggtttaaagggacgggaccctagttccggacgtaacgtaacggcgttaacgttccgtaaggggaacgggggtacgttaaccgggg

SEQ ID NO: 399989 - DNA, 600 bp, Homo sapiens
  misc_feature: GZ8MTXP02H7VHU.10.83.H06.1.454.CMB.2.raw
  modified_base (520)..(520): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttggcttagctgggttttcctgttgctattttaaaggtgtccaatgtgaggtgcagttggtggagtctgggggagcttggtcagccagggcggtccctgagactctcttgtacagcctctggtatttaggttcgtgtattatgctatgagcgtgggttccggcagggcctaccgaggggaaggggctgggagtggggttagtttcagttagagcatacgctagtggtggggcttgagactccgcgtcgtcgtagtgaaaacggcccgaattccaacctatcctacaaagacgaaccgaacctaaacccgaaaacgtcccgtaccgaccctaacgtaaggaaacgtggaacacgaccgtaagaaacgacgaacgacaacgngacgtactatagttgtagtaggaacggacacgtcgacgtaagtacgacgtacgtaccgtaagggacggggtaactacggg

SEQ ID NO: 399990 - DNA, 582 bp, Homo sapiens
  misc_feature: GZ8MTXP02J1TSU.10.83.H06.1.454.CMB.2.raw
tcagcatagtagtgcacgaccggtgctcgatttagatcacgtgcgtcgcgggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggaggcttggttcagccgagggcggtccctgagactctcttgtacagcctctggtattttaggtttcgtgattatgctatgagctggttccggcaggctccgaggggaggggctgggaggtgggtagtttcattagaagcatacgcctagtgggtggggcttcgagactcccggccgtcgtctggtagaaacgggccgtattccaccatctacaagagacgactacccaaaagccctcgaccctacgtaggaaatggacacgacctagaaaacgcgaacgacacgaggcgtctaattagttgtaggttaaggacgggaccagtcgacgtaagtacgctacgttaccgtagggacggggtactacgg

SEQ ID NO: 399991 - DNA, 757 bp, Homo sapiens
  misc_feature: GZ8MTXP02G5SRH.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttggcttagcttgggttttccttgttgctattttaaaaggtgtccaatgtgaggtgcagttggtggagtcgtgggggaggtcgttggttcgagccgagggccggtcccgtgacgtactctcttgtacagtcctcgtggtagttttaggttcgtgtattagtgtctatgagtcgttcgggtttccggcgacggcgtaccggaaggggtaacggggtcgtggggtaggttggggtttaggtttacgtaagttaagaagtactagtacgtccttaggtggggtcggggtcttacgacgtacgtcccggtccggtcgttcgtaggtaacggaaacgggtcccgtagtttacccaaccgtactaccgtaacgaaacgtaacggaaaccgaaccgttaaaccccgaaaaaccgtccccgttaccccgtaaccccgttaaccggtaaagggtaaaacgttacgggaaaccgaacggtaacccgaaacggaaaacggaccggaaaccgaaaccgaacgacgggtacgttacgttaagtttagttagggttagttaaaggacgggtaaccgtacgtccgagtaagtaacgacgtacgtaccggtagggacggggtacgttaaccggg

SEQ ID NO: 399992 - DNA, 550 bp, Homo sapiens
  misc_feature: GZ8MTXP02IMQ4W.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggagcttggttcagccagggcggtccctgagactctcttgtacagcctctggattttaggttcgtgattatgctatgagctggttccggcaggctccgaggggaaggggctgggagtgggtaggtttcagttagagcatagcctatggtggggcttcgagatccgcgcgtctgtgaaaggccgattcaccatctcaagagacgatacccaaaagccctcgacctaccgtaggaaactggacagaccctagaaacgcgacgacacgagcgtctattattgtgttagacggtaccacgtcgacgaagtacgctacgttcctaggaggggacgtacgg

SEQ ID NO: 399993 - DNA, 734 bp, Homo sapiens
  misc_feature: GZ8MTXP02J2SV5.10.83.H06.1.454.CMB.2.raw
  modified_base (247)..(247): a, c, t, g, unknown or other
  modified_base (300)..(300): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtgagtctgggggagcttggtcagccagggcggtccctgagactntctgtacagcctctggtatttaggttcgtgattatgctatgagctggttccgnaggctcgagggagggctggagtgggtagttcattagaagcaatcgcctagtggggtagggtcttcgagtactccggaccgtcgtcgtggtacgaaaacggggtccctaattaccaaccctacttaccgtaccgaaaggacggaaccgaaaccttaacccccgaaaaacgcccccgttaccgggtacccccttaacccgttaggggtaaaacgtcgggaaaccaccgggacccgtaaaggaaaaaccggtacccggaaaccgggtaaccaaaccggacggggtacccgttaccgtttaacgtttacggtttacggttaacgggtttaaggaaaccgggggtacccaacggttaccccgggaacggtaagttaaacgggccgtaaacgggttttacccccggtaaaggggaacggggggttacttaaacccggggg

SEQ ID NO: 399994 - DNA, 543 bp, Homo sapiens
  misc_feature: GZ8MTXP02J2INB.10.83.H06.1.454.CMB.2.raw
  modified_base (282)..(282): a, c, t, g, unknown or other
  modified_base (299)..(299): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagttggtggagtctgggggagcttggtcagccagggcgtccctgagactctcttgtacagcctctggtatttaggttcgtgattangctatgagctggtccgnaggctcgagggaggctggagtgggtagttcagttagagcatcgctagtggtgggcttcgagactccgccgtcgtctgtaggaaacggccgattccaccatctacaagagacgactacccaaaacgcctacgaccctacgtaggaatggacacgacctagaaacgacgaacgacacgagcgtctattagttgtagttagacggaccacgtcgacgaagtacgcacgtaccgaggagggagtacgg

SEQ ID NO: 399995 - DNA, 752 bp, Homo sapiens
  misc_feature: GZ8MTXP02G81QG.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagttggtggagtcgtggggggagtcgttggttacacgccggagggctacgttcccgtagacgtaccttccttcgttacgtacgacgtcccttcgttaggttagttttacggtttcgtagttatttagtgtacttagtcggtagtccggtttcggggttcccgacggtacggtcccgtacgggaagggggacgggtcggtagggtagggttggggtttacggttacgtaagttaaggaacgtacgtaagtacggtaccttagggtcgggggtcgggttccttacgaggtaccgtcccggcccggttacgttcggtaggaaacgggtaaaccggtccgttactacccgaacctattcccgaaagaaaggaccgaacgtaaccctaaacccgaaacgtcccgtaccgtacccgtaacgtaaggtaactcggaacaccgtacgaaaggaaacgccgaaacgaccacggtacggtcctttaattaatttggtggttaacggtacggaccggtaacctgtaccgaagtataccgtcgtacgttacggaaggggtaggtaccg

SEQ ID NO: 399996 - DNA, 560 bp, Homo sapiens
  misc_feature: GZ8MTXP02HXAG5.10.83.H06.1.454.CMB.2.raw
  modified_base (298)..(298): a, c, t, g, unknown or other
  modified_base (314)..(314): a, c, t, g, unknown or other
  modified_base (351)..(351): a, c, t, g, unknown or other
  modified_base (370)..(370): a, c, t, g, unknown or other
  modified_base (376)..(376): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagttggtggagtcgtgggggagcttggttcagccagggcgtcctgagctctcttgacagcctcgtggtattttaggtcgtgattatgctatgagctggtccgnaggctcgagggagggntggagtgggtagttcattagagcagtacgctagtggngggtcttcgagactccgcngtctgngaaagccgtatcacatctacaagacgaccgactacccgaaaacgccctacgacctaccgtaggaaacgtggacagaccctaagaaacgcgaacgacacgacggcgtacttattgttagtgttaacggacggtaccagtacgacgaagtacgactacggttaccgaggtacggggtacgtaccgg

SEQ ID NO: 399997 - DNA, 553 bp, Homo sapiens
  misc_feature: GZ8MTXP02IK9J4.10.83.H06.1.454.CMB.2.raw
  modified_base (297)..(297): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttcctgttgctattttaaaggtgtccaatgtgaggtgcagttggtggagtcgtgggggagcttggtcagccagggcgtccctgagctctcttgacagcctctggatttaggttcgtgattatgctatgagctggtccggnaggctccgagggagggctggagtgggtagtttcattagagcatagcctagtgggtgggcttcgagactccgcgcgtctgtgaaacggccgattcaccatctacaagagaccgaactacccaaaagcctcgacctaccgtaggaaatggacagacctagaaacgcgacgaacacgaggcgtactattagttgtagttaagacgggaccaagtcgacgaagtacgacgtacggttaccgtaggacggggtacgtacgg

SEQ ID NO: 399998 - DNA, 567 bp, Homo sapiens
  misc_feature: GZ8MTXP02F8MIS.10.83.H06.1.454.CMB.2.raw
  modified_base (305)..(305): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggaggcttggttcagccagggcggtccctgagactctcttgtacagcctctggtatttaggttcgtgattatgctatgagctggtccggnaggctccgagggagggctggagtgggtagttcattagagcatacgcctagtgggtggggtcttcgagacgtcccgccgtcgtctgtaggaaacggccgtattccaccatctacgaagagacgactaacccaaaagccctcgacctaccgtaggaaatggaacacgacctaaggaaaacgcgaacgacacgaggctactattagttgtagttaggacggacagtcgacgaagtagacgtacgttccgtaggacgggagtacgg

SEQ ID NO: 399999 - DNA, 652 bp, Homo sapiens
  misc_feature: GZ8MTXP02HSGGR.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggagcttggttcagccagggcgtcctgagactctcttgtacagcctctggtattttaggttcgtgtattatgtctatgagtcgtggttccggcagggcctccggaaggggaaggggctaggggaggttggggttaggtttcagttaagaagctatacgccgtagtggggtggggtctttccgaagtacgtcccggccgtcgttcgtaggtagaaaacgggtcccgtaattaccaacccatctacgaaacgaagaccgaactaaccccaaaacgccctaccgacccttaaccgtaggaaaacgttcggacaacgacccgtaagaaaacggcgaacgaacaacgacgggtcgtacttaatttagtttagtacgttaaggaacggacctagtccgagtaacgtagacgtacggtaccgtagggacggggtacgtaaccgg

SEQ ID NO: 400000 - DNA, 611 bp, Homo sapiens
  misc_feature: GZ8MTXP02IH6N7.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttggcttagctggttttcctgttgctattttaaaggtgtccaatgtgaggtgcagttggtggagtcgtgggggagcttggtcagccagggcgtcctgagactctcttgacagccctgtggtattttaggttcgtgtattatgctatgagcgtggttccggcaggctccgaggggaggggctgggaggtgggttagtttcagttagaagcagtacgcctagtgggtggggtcttacgaagacgtcccgcgtcgtcgtgtagaaacggccgattcacatctacaagagtaacgaactacccgaaaacgccctaccgacccttaacccgtaggaaaacgtaggaaccacgacccgtaaacggaaacgaccgacgaccgacgacggtccgttattagttagttagttagttaacggacggtacgtacgtcgacgtaagtacgtacgtacgttacggagggtacgggtacgtacgg

SEQ ID NO: 400001 - DNA, 620 bp, Homo sapiens
  misc_feature: GZ8MTXP02GGJ07.10.83.H06.1.454.CMB.2.raw
  modified_base (305)..(305): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttgggcttagctgggttttcctgttgctattttaaaggtgtccaatgtgaggtgcagttggtggagtcgtgggggagtcttggttcagccagggcggtccctgagactctcttgtacagcctctggtatttaggtttcgtgtattatgctatgagctggttccggnaggctccgaggggaaggggctgggtaggtggggtaggtttcagttagaagctagtacgacctagtgggtggggtcttcgagtacgtcccggccgtcggtctgtaggaaacggccgtattcaccatctacgaaagacgacgactaacccgaaaacgccctacgaccctaccgtaggaaactggacacgaccgtaagaaaacgcgaacgaacgacgacggcgttactacgtttattggtaggtttacggacggggtacctagtcgaccgtaagttacgacgttacggttaccgtacgggaggggtacgttaaccggg

SEQ ID NO: 400002 - DNA, 639 bp, Homo sapiens
  misc_feature: GZ8MTXP02GCX4K.10.83.H06.1.454.CMB.2.raw
  modified_base (257)..(257): a, c, t, g, unknown or other
  modified_base (390)..(390): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtctgggggagcttggttcagccagggcgtccctgagactctcttgtacngcctctggatttaggttcgtgattatgctatgagctggttccggcaggctccgaggggagggctgggagtgggtagtttcattagagcatacgcctagtgggtggggcttacgagactcccggcgcgttacgnggtagaaaagggtcccgaattccgaaacccattcctaacaaacgtacgaccgtaactaaccccaaaaaggcccctacggaccccttaaccgtaggaaaactggaacacggaccctaaggaaaacggccgaacgaccacgacgggtacgttacttaacgttatttggttagtttaacgggaacggggtaaccacgttacgacgaagtacgacgttacgtttccggaagggtacggggacgttaaccgggg

SEQ ID NO: 400003 - DNA, 619 bp, Homo sapiens
  misc_feature: GZ8MTXP02JTVCS.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggagcttggttcagccagggcgtccctgagactctcttgtacagcctcgtggtatttaggttcgtgtattatgctatgagtcgtggttccggcaggtctaccgaggggaagggcgtgggaggtggggttagtttcgattagagcagtacgcctagtgggtggggtcttacgagacgtccgccgtcgtcgtgtacgaaacggccgtattccaacctactacgtacaaagacgaccgtaactaaccccgaaaacgcccgtaccgaccctaccgtaaggtaaacgtcggaacacggtaccaagaaaacgcgaacgacacgacggtcgtacttagttattggtacgttaggacggtactacgtcgacgaagtacgacgtacggtaccgtaggacggggtacgtaacgg

SEQ ID NO: 400004 - DNA, 578 bp, Homo sapiens
  misc_feature: GZ8MTXP02GUVBR.10.83.H06.1.454.CMB.2.raw
  modified_base (297)..(297): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttggcttagctgggttttcctgtgctatttaaaggtgtcaatgtgaggtgcagttggtggagtcgtgggggagcttggttcagccagggcggtccctgagactctcttgtacagcctctggatttaggttcgtgattatgctatgagctggttccggnaggctccgagggagggctggagtgggtagtttcattagaagcatagcctagtggtggggcttcgagatccgcgcgtctgtagaaaggccgattcaccatctacaagagacgactacccaaaagccctacgacctacccgtaggaaagtcggacacggacccgtaagaaaacgccggaacgaacaacgacggacgtactagtttagttgtaggtttaggacggggtacccaagttcgacgtaagtacgctacggtttccgaagggtaggggacgttaaccgg

SEQ ID NO: 400005 - DNA, 729 bp, Homo sapiens
  misc_feature: GZ8MTXP02IIKJL.10.83.H06.1.454.CMB.2.raw
  modified_base (247)..(247): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttgggcttagctgggttttcctgttgctattttaaaaggtgtccaatgtgaggtgcagttggtggagtcgtgggggagcttggtcagccgagggcgtcctgagctctnttgtacagcctctggattttaggttctgattatgctatgagctcggttccggcagggctccgaaggggaacggggctagggaggttggggtaggtttcaagtttaagagtcaattacgaccgttagtggggtggggtctttacgaagtacgttcccggccgtcggtactggtagaaaacgggtcccgacttcacctatctacaaggtaagaaccgtaaactaaccccgaaaaacgtccccgtaccgtacccgttaacccgtaaagggaaaacgtacggaacgaacgggtaccccgtaaaggaaaaacgaccggaaacgaaccgaaaccggacgggtaaccgtccttaaacgtttaacggtttaggttaagggtttaaacggaaacgggggtaaccctaaacggttaccggtaacccgtaagtaacggtacggttaaccggttaacccggtaagggtaaacggggggaacgtttaaaccgggg

SEQ ID NO: 400006 - DNA, 701 bp, Homo sapiens
  misc_feature: GZ8MTXP02FFGMW.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagttggtggagtcgtgggggagcttggttcagccagggcggtccctgagactctcttgtacagcctctggtatttaggttcgtgattatgctatgagctggttccggcaggctccgaggggaggggctgggaggtgggtaggtttcatttagaagcatacgcctagtgggtggggtcttcgagtacgtcccgccggtcgtctggtagaaaacgggcccgtaagttccaaccctatacctacaaacgagaaaccgtactaacccccaaaaaggcccctaccggaccccgttaacccgtaagggtaaaacttacggggaaccaaacggtaccctaaacggaaaaacgccgggaaaacccgaaccgaaacgtaacgggaccgtttaacttaaacgtttagtttagggtttaaggttaaacgggaaacggggaacccttaaagtccggacgaagttaacggacgtaacggtttacccgtaacgggaacgggggtacgtttaaccggg

SEQ ID NO: 400007 - DNA, 622 bp, Homo sapiens
  misc_feature: GZ8MTXP02JF9O1.10.83.H06.1.454.CMB.2.raw
  modified_base (280)..(280): a, c, t, g, unknown or other
  modified_base (304)..(304): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtgggggagcttggttcagccagggcggtccctgagactctcttgtacagcctctggtatttaggttcgngattatgctatgagctggttccgnaggctcgagggaggctggagtgggtagttcagttagagcatacgctagtgggtggggcttacgagacgtccggccgtcgtcgtgtaggaaaacgggcccgtaattccgaaccctatcctacgaaagacgaaccggaactaacccgaaaacgccctaccgacccttacgtacggaaaactgggaaccaggtaccctaggaaaacgcgacgaacagacggcgttacttaattagttggtaggttaaaggaacggggtaccctaagtccggacgaagtacggacgtacggttacccgtaggggacggggtacgttaaccgg

SEQ ID NO: 400008 - DNA, 818 bp, Homo sapiens
  misc_feature: GZ8MTXP02JDYIQ.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcagttggtggagtcgtgggggagtcttggtcagccgagggcggtcctgagctctcttgtacagtcctcgtggtatttaggtttcgtgtattatgtctatgagtcgtcggttccggcaggcgtaccggaggggaacggggtcgtagggtaggttggggttaggtttacgtaagttagaagactagtaccgtaccgttaggtcggggttcggggtcctttacgaacggtaccgtcccggtcccggtccggttccgttaggtaacgggtaaaaccgggtcccgttaaacgttacccgaaacccgtaacttacccgttaacgaaaacggtaaacggaaacccggtaaaccctaaacccccgtaaaaaccggtcccccgttacccgtacccccgttaaaccgttaaacggggtaaaacgttacgggaaacccgaacgggtaacccgtaaacgggaaaaaccggaccggaaacccggaaacgaaaccggtacgggggtaacccttacgtttaaacgtttaacgtttagggttaacggttaaacggaccggggtacctaaacggtccgaacgtaagttacggacgttacggttaccggtaagggtacggggtaacgttaacccgggg

SEQ ID NO: 400009 - DNA, 582 bp, Homo sapiens
  misc_feature: GZ8MTXP02I53PQ.10.83.H06.1.454.CMB.2.raw
  modified_base (256)..(256): a, c, t, g, unknown or other
  modified_base (300)..(300): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagacccaccaaccatggagtttgggcttagctgggttttcctgtgctatttaaaggtgtccaatgtgaggtgcagttggtggagtcgtgggggagcttggttcagccagggcggtccctgagactctcttgtacngcctctggatttaggttcgtgattatgctatgagctggttccgnaggctccgagggaagggctggagtgggtagtttcagttagagcatagcctagtggtggggtcttcgagacgtcccgcgtcgtcgtgtagaaacggccgtacttccaacctatctacaaagacgaccggaactaccccgaaaacgcctaccgacctaccgtaggaaacgtggaacagacctaagaaaagcgaacgaacacgacgggctacttaattagtgtacgttaggacgggtacctagtccgagaagtacgacacggttccagggtagggacgtaaccgg

SEQ ID NO: 400010 - DNA, 665 bp, Homo sapiens
  misc_feature: GZ8MTXP02IC56S.10.83.H06.1.454.CMB.2.raw
  modified_base (182)..(182): a, c, t, g, unknown or other
  modified_base (367)..(367): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtntccaatgtgaggtgcaggttggtggagtcgtgggggaggctttggttcagccgagggccggtccctgagacttctcttgtacagtccttcgtggtattttaggttcgtagtattatgctatgagtcgtggttccggcagggctccgaaggggaggggctgggaggttgggttagtttcagtagancatacgctagtgggtggggtcttacgacgtacgtccgccgtcgttcgttggaacggaaacggcccgtaactttccaacctacttacctacgaaacgagaaccgtaactaaccccgaaaacgtctacccccccccgatacccgtaagaaagtacgacacgaccgtaaggaaaacgacggaacgacctaacgacggtcgttaacttaagtttagtttggttaacgttaaggaacgggtaccaacgttcgacgtaagtacgacgttacggttaccgtaaggggtaggggtaacgtaacggg

SEQ ID NO: 400011 - DNA, 560 bp, Homo sapiens
  misc_feature: GZ8MTXP02JTTQM.10.83.H06.1.454.CMB.2.raw
  modified_base (371)..(371): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaggtgtccaatgtgaggtgcagttggtggagtcgtgggggagcttggtcagccagggcggtcctgagactctcttgtacagcctctggtatttaggttcgtgtattatgctatgagctggttccggcaggctccgaggggaggggctgggaggtgggtagtttcagttagaagcatacgctagtggtggggcttnagatccgcgcgtctgtagaaacgccgattcaccatctacaagagacgactacccgaaaagcctacgacctacgtaggaaactggacagacctagaaacgcgaacgacacgaggcgtacttattagttggtacgttaggacggaccacgtcgacgaatacgccgtagttccgtaggacggggacgtacgg

SEQ ID NO: 400012 - DNA, 554 bp, Homo sapiens
  misc_feature: GZ8MTXP02FOVF1.10.83.H06.1.454.CMB.2.raw
  modified_base (411)..(411): a, c, t, g, unknown or other
  modified_base (434)..(434): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctatttaaaaggtgtccaatgtgaggtgcagttggtggagtcgtgggggaggcttggttcagccagggcgtccctgagactctcttgtacagcctctggatttaggttcgtgattatgctatgagctggttccggcaggctccgaggggaaggggctgggaggtgggtaggtttcattagagcatacgcctagtgggtggggcttcagactccgcgcgtcgtgtagaaaggccattcacatctnaagagacgactacccaaacgccncgacctaccaggaaatcgaacacgacctaagaaacgcgaacgacacgagcgtactattagtgtagtagacggtaccagtccgagaagtacgacgtacgtaccgtaggacgggtagtacgg

SEQ ID NO: 400013 - DNA, 636 bp, Homo sapiens
  misc_feature: GZ8MTXP02JB8M2.10.83.H06.1.454.CMB.2.raw
  modified_base (259)..(259): a, c, t, g, unknown or other
  modified_base (455)..(455): a, c, t, g, unknown or other
  modified_base (460)..(460): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgctattttaaaaggtgtccaatgtgaggtgcagttggtggagtcgtggggggagtcttggttcagccgagggcgtcctgagactctcttgacngcctgtggtattttaggtttcgtgtattatgcttagtgagtcgtggttccggcgacgggtcctccggaaggggaaggggtcgtggggtaggttggggttaggtttcaagttaggaagctaatacggtcctaggttgggtcggggtcttacgaagtacgtcccgccggtcgtcgtagtagaaacggccgtatcaccntctanaagagacgactaacccgaaacgccctccgaccctaaccgtaggaaaacgtggaaccacgtacccgaaggaaaacgcgaaccgaacacgtaacggcttacgttattagtttagtaggttaggaacgggacctaagccgacgaagtcgactaggttccgaaggaggggtacgttacgg

SEQ ID NO: 400014 - DNA, 734 bp, Homo sapiens
  misc_feature: GZ8MTXP02J1UIJ.10.83.H06.1.454.CMB.2.raw
  modified_base (337)..(337): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagcttgggttttccttgttgcttattttaaaggtgtccaatgtgaggtgcaggttggtggagtcggtggggggaggtctttggttcaggcccgaggggtccggtccctgacgtacctcttcttgtacacgtccttcgtggtattttagggtttcgtgtaatttatgcttagtgacgtcgtggttccggnacggcgtccggaaggggaacggggtcgtgggaggttggggttagtttcaagttaagaacgctaagtaccgccgttagtcggggtaggggtccttacgaagtaccgtcccggcccggtacgttcgtagggtaacggaaaacgggcccgtaacgtttacccaacctaacgttacctaacgaaacggaacggaaccggtaaacctaaacccccgtaaaaacgtcccctacccggtaacccttaacccggaaaggtaaacgtcggaacaacggtaccgtaagaaaacggaccgaaccgaaccacggacggtacgttacttaacgtttagttggtacgtaaggtacggacctagtccgagtaagtacggtcgtacggtaccgtacggaggggtacgtaacgg

SEQ ID NO: 400015 - DNA, 757 bp, Homo sapiens
  misc_feature: GZ8MTXP02GUPCY.10.83.H06.1.454.CMB.2.raw
  modified_base (301)..(301): a, c, t, g, unknown or other
  modified_base (345)..(345): a, c, t, g, unknown or other
tcagcatagtagtgcacgaccggtgctcgatttagatcacgtgcgtcgcgggggagctctgggagaggagccccagccgtgagattcccaggagtttccacttggtgatcagcactgaacacagaccaccaaccatggagttgggcttagctgggttttccttgttgctatttaaaggtgtccaatgtgaggtgcagttggtggagtcgtgggggagcttggttcagccagggcgtccctgagctctcttgtacagcctctggtatttaggttcgtgattatgctatgagctggtccggcnggcctccgagggagggcgtggaggtgggtaggtttcattagagnatagcctagtgggtggggtcttacgagactcccggccgtcgtctgtaggaaacggccgtattccgacctactactacgaaagacggaaccgtaactaaccccgaaaacgccccgtaccgtaccccgttaaacccgtaaggggtaaaacttacggggaaacctaacgggacccttaaacggggaaaaaccggtacccgggaaaccgaaaaccgtaacccggaaacgggggttaccgggtttaaaccctttaaaacggtttttaacggttttaacgggtttacggggtttttaaaaggggaaccgggggttaaaaccccgtaaggttaccccgggtacggtaagtttaaccggaccgtttaaacggtttaccccggtaaagggggtaaccgggggtacggtttaaaacccgggg

SEQ ID NO: 400016 - DNA, 723 bp, Homo sapiens
  misc_feature: GZ8MTXP02HOFXR.10.83.H06.1.454.CMB.2.raw
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagcttgggttttccttgttgtctattttaaaaggtgtccaatgtgaggtgcagttggtggagttcgtgggggagtcttggttcaggccgagggcggtccctgagactctcttgacagtcctgtggtatttaggtttcgtgtattatgctagtgagtctcgggttccggacgacgggtccgtaccggaagggggaaggggtcgtaggggtaggttggggtttacggtttacgtaagttaaggaagtactagtacgccgttaaggttcggggtacggggtcttaccgaggtaccgttccccggacgtcgttcgtaggtaacggaaacgggtcccgtacttaccaacccgtataccgtaacgaaagtacgaaaccgaactaaccccgaaaacgtcccgtaccgtacccgttaaccgaaggtaaacgtcggaacacggtaacaacggaaacggcgaaacgtacgacgacggtctacttattacgtttaggtacgttaaaggacgggtaccaacgttccgaggtaacgttacggaccgtttacggttacggtaggggtaacggggtacggttaacccggg

SEQ ID NO: 400017 - DNA, 574 bp, Homo sapiens
  misc_feature: GZ8MTXP02F0JZ0.10.83.H06.1.454.CMB.2.raw
  modified_base (349)..(349): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagttgggcttagctgggttttccttgttgctattttaaaaggtgtccaatgtgaggtgcaggttggtggagtcgtgggggaggcttggttcagccgagggcgtccctgagactctctgtacagcctctggtattttaggttcgtgtattatgctatgagtctggttccggcaggctccgaggggagggctggaggtgggtgttcattagagnatgcctagtgggtcggggtcttcgagactccgccgcgtctgagaaacgctatcactatcgtacaagacgaccgactaccccgaaaagcctccgacctacccgaggaaactggacacggcctaagaaacgcgaacgacaccgaggcgtactagttattggtagtaagacggacctagtccgacgtaagtacgacgttacggttacctaggggagggacgttaacgg

SEQ ID NO: 400018 - DNA, 645 bp, Homo sapiens
  misc_feature: GZ8MTXP02I1FEI.10.83.H06.1.454.CMB.2.raw
  modified_base (291)..(291): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagttggtggagtcgtgggggagcttggttcagccgagggcgtccctgagactctcttgacagtcctcgtggtattttaggttcgtgtatttangtctatggagtcgtggttccggcagggctccgaggggaagggctgggagtgggtagtttcagttagagcatacgcctagtgggtgggtcttcgaagtacgtcccgccgtcgtcgtgtagaaacggccgtatccaccatctacaagacgacgactaccccgaaaacgccctacgaccctaccgtaggaaacgtcgaccgacgtacccaaggaaaacgccgaacgtaacgacgaggtccgttacttaagtttacgtttaggttacggtttaaacggacggggtacccaagtccggtaacgtaagttacggacgttacggttacccgtaagggggtacggggtacgtttaaccgggg

SEQ ID NO: 400019 - DNA, 774 bp, Homo sapiens
  misc_feature: GZ8MTXP02FULLR.10.83.H06.1.454.CMB.2.raw
  modified_base (298)..(298): a, c, t, g, unknown or other
tcagcatagtagtgcacgaccggtgctcgatttagatcacgtgcgtcgcgggggagctctgggagaggagccccagccgtgagattcccaggagtttccacttggtgatcagcactgaacacagaccaccaaccatggagtttgggcttagcttgggttttccttgttgcttattttaaaaggtgtccaatgtgaggtgcaggttggtggagtcgtgggggaggtcttggttcaggccgaggggccggtccctggacgactcttcttgtacagtcctcttaggtattttaggttcgtntattatgctagtgagtcgtggttcccggcagggtcctaccggaagggggaaggggtcgtgggaggttaggggttaggtttcaagttaagaacgtctagtacgtccgtaggtggggtcggggtacttacgaacggtacgtcccggaccgtcggttcgtacggtaggaaaacggtcccgtaattacccgaacctatacctacgaaagtacggaaccctaactaacccccaaaacggtcccctaccggaacccttaacccgtaagggaaaacgtcggggaacccaacgggtacccgtaaaaggaaacggaccgaaacggaaaccgacgtaacgggtacgttacttaaacgttttaggtttacggttacggggtttaaacggaaccggggtaaccctaaggtccccggtaagtaacgttaacggacccgttaacggtttaccggtaaagggggtaaccgggggtacgtttaaacccgggg

SEQ ID NO: 400020 - DNA, 599 bp, Homo sapiens
  misc_feature: GZ8MTXP02FN5WO.10.83.H06.1.454.CMB.2.raw
  modified_base (289)..(289): a, c, t, g, unknown or other
  modified_base (306)..(306): a, c, t, g, unknown or other
  modified_base (322)..(322): a, c, t, g, unknown or other
  modified_base (326)..(326): a, c, t, g, unknown or other
tcagcatagtagtgcacgaccggtgctcgatttagatcacgtgcgtcgcggggagctctgggagaggagccccagccgtgagattcccaggagtttccacttggtgatcagcactgaacacagaccaccaaccatggagtttgggcttagctgggttttccttgttgcttattttaaaaggtgtccaatgtgaggtgcagttggtggagtcgttgggggaggcttggttcagccgagggcgtcctgagactctcttgtacagtcctctggtatttaggttcgtgattangctatgagctggtccgnaggctcgagggagggntggngtgggtaggttcattagagcatacgcctagtgggtggggcttgagtactccgcgtcgtcgtggtagaaaacggcccgtaagttccaaccctatccgtacaaagacgacgaactaccccaaaaacgccctaccgacctaccgaggaaacgtgacagccctaagaaaacgcgaacgacacgacggcgtacttaagttattggtagttaaagggacggtacctaagtcggacgaagtacgactacggttaccgtagggtaaggggacgttaaccgg

SEQ ID NO: 400021 - DNA, 577 bp, Homo sapiens
  misc_feature: GZ8MTXP02H6SNG.10.83.H06.1.454.CMB.2.raw
  modified_base (247)..(247): a, c, t, g, unknown or other
  modified_base (255)..(255): a, c, t, g, unknown or other
  modified_base (267)..(267): a, c, t, g, unknown or other
  modified_base (282)..(282): a, c, t, g, unknown or other
  modified_base (288)..(288): a, c, t, g, unknown or other
  modified_base (365)..(365): a, c, t, g, unknown or other
  modified_base (386)..(386): a, c, t, g, unknown or other
  modified_base (392)..(392): a, c, t, g, unknown or other
tcagcatagtagtgcacgaccggtgctcgatttagatcacgtgcgtcgcgggggagctctgggagaggagccccagccgtgagattcccaggagtttccacttggtgatcagcactgaacacagaccaccaaccatggagtttgggcttagctgggttttccttgttgctattttaaaaggtgtccaaatgtgaggtgcagttggtggagtcgtgggggaggcttggttcaggccagggcggtcccngagactcncttgacagcctntggatttaggttcgngattangctatgagctggttaccggcaggctccgaggggaaggggctgggagtgggtagttcaatagaagcatagctagtggngggtctcgagactccggaccncgtcgngtaggaaaacggtccgaattcaacatactacaaagagaacgaactaccccgaaaaagccctacgacccgtaactagggaaactagggacaagaccagaaaacgcgaaacgacaacgagccgtactaattagttgtagttagaacgggaccaatcgagaatacgcacgttcgaggagggtagtacg

SEQ ID NO: 400022 - DNA, 666 bp, Homo sapiens
  misc_feature: GZ8MTXP01BBW95.51.62.F07.1.454.CMB.2.raw
tcagcgatcgtatacacgaccggtgctcgatttagtagtcgcataaagggaaagggggatcaggactcctcagttcaccttctcacaatgaggctccctgctcagctcctggggctgctaatgctctgggtcccaggatgcacgtggggatgttgtggtgactcagtctcctctctccctgcccgtcacccgttggacaggcgcctccatctcctgcaggtctagtcacagcctcctacacagtgataggaaacctcctattgtactggttcagtcagacggcctggacctaatccaccgaaggtcctacctttaatttaagtaacggttttactaaaggttccgggtacgttttcgggggcccaaggtacctaggtaccttcgaaggtcggacgtaggtcgggtacctaacggacctactacctacttacgaactaacgtagaaactcgagtacggaggggtcggaggtacgtaggtaggttagtttagggttatacgtgtacaggtagaacgtaaggtacacgtacgtcgacccgttacgtacgtaccgtttacgggacccgtaaggggaacctaaggccgttaacggacgtaacgtaaaccgttaaacggttcgttacgggtcggtacgtcggacctacttacgtttccgttcgtttaacccg

SEQ ID NO: 400023 - DNA, 586 bp, Homo sapiens
  misc_feature: GZ8MTXP02HX496.51.62.F07.1.454.CMB.2.raw
tcagcgatcgtatacacgaccggtgctcgatttagtagtcgcataaagggaaagggggatcaggactcctcagttcaccttctcacaatgaggctccctgctcagctcctggggctgctaatgctctgggtcccaggatgcactggggatgttgtggtgactcagtctcctctctccctgcccgtcacccttggacaggccggcctccatctcctgcaggtctagtcacagcctcctacacagtgatggaaacacctacttgactttggttcagcagagcctggccaatctccaagctccttattataaggtttcaagtcgggtactttggggcccagacagtacttcagcggcaggtgggtcacgcactcacttcacactagaaaatcaagcgaagggtcgaggtctaggaggtagtttaggggtttattacgtggactagttcgacgtaaaggtacaacgtacgtcggacccttacggtactacgttttacggacccgtaacggggaccaaacggtccgtacgagactaaccgaaaaccgtaacgtggtaacggactacggacctaaccacttccgtacgttcc

SEQ ID NO: 400024 - DNA, 557 bp, Homo sapiens
  misc_feature: GZ8MTXP01ESBLU.44.56.F01.1.454.CMB.2.raw
  modified_base (395)..(395): a, c, t, g, unknown or other
  modified_base (420)..(420): a, c, t, g, unknown or other
  modified_base (429)..(429): a, c, t, g, unknown or other
  modified_base (436)..(436): a, c, t, g, unknown or other
  modified_base (445)..(445): a, c, t, g, unknown or other
  modified_base (472)..(472): a, c, t, g, unknown or other
  modified_base (492)..(492): a, c, t, g, unknown or other
  modified_base (501)..(501): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtggcggaggtcggggggggcttggcacgagccgagggcggtctctgagactctcctgtgtagtctcaggattcagtcttagtgattatcacttggcctggggtcccgtcaggctccgaggggaagggggtctttggagtggatctactttcgcagaatggtaaacgttagtaggtagaaaagtaaagngtacgccgcgtctgtaggaaggganattcacgtncgaaggntgactccanagtgtgaccattacaaatgagcaaccngacgcccgaagcacaggctntaattacgngccgcgaggcgttacgttcggttcgggaactcgaatgcttagtttgaagttaaggg

SEQ ID NO: 400025 - DNA, 609 bp, Homo sapiens
  misc_feature: GZ8MTXP01EJLGZ.44.56.F01.1.454.CMB.2.raw
  modified_base (368)..(368): a, c, t, g, unknown or other
  modified_base (386)..(386): a, c, t, g, unknown or other
  modified_base (410)..(410): a, c, t, g, unknown or other
  modified_base (431)..(431): a, c, t, g, unknown or other
  modified_base (476)..(476): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcgggagggtcggggggggggcttgggcacagccgaggggcggtctctgagactctctgtgtagtctcaggattcagtcttagtgattatcacttggcctgggtcctcaggctcgagggagggcttggagtggatcactttgcagaatgaaacgttntggtaggaaaagtaaagngtacgccgtgtctgtgaagggganattcgacgtctcgaaaggggntaggaactccaaactagttgtggacctaatttacaaaattggaanacaaacctggacgaccccggaaacgacaacgacggtcgtcctaatttaacgcggccgacccgaggggccttaaggttccccgttgggggaacccgttcgaagtttccgggacttagtttaagttaagttaagg

SEQ ID NO: 400026 - DNA, 570 bp, Homo sapiens
  misc_feature: GZ8MTXP01EA9QB.44.56.F01.1.454.CMB.2.raw
  modified_base (451)..(451): a, c, t, g, unknown or other
  modified_base (540)..(540): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcccagaccaccaaccatggagtttgggctaatcttgattttccttgtagttttttagaaggtgtccagtgcgaggggcgactggcggaggtcgggggggggcttgggcacagccagggcggtctctgagactctcctgtgtagtctcaggattcagtctagtgattatcacttggcctgggtcctcaggctccgagggaagggcttggagtggatcacttttcgcagtaatgaaacgttatggtaggaaagtaaaagagtaacggccgcgttcgtggtaggaaaggggaagatttcaaccggtctacgaagggatggaactccaaanagtgttgacctaatttaacaaagttgaagaccaaaccgtgaacgacccgagaaccacacgggctcattaactgcgccaggctattccgngggactcgatgctagttgaagttgtcgggg

SEQ ID NO: 400027 - DNA, 678 bp, Homo sapiens
  misc_feature: GZ8MTXP01DXJNK.44.56.F01.1.454.CMB.2.raw
  modified_base (372)..(372): a, c, t, g, unknown or other
  modified_base (388)..(388): a, c, t, g, unknown or other
  modified_base (429)..(429): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttgggctaatcttgattttccttgttagtttttagaaggtgtccagtgcgaggggcgacgtgggcggagggtcgggggggggcttggcacgagccgaggggcggtctcgtgagactctcctgtgtagtctcaggattcagtcttagtgtattatcacttggcctgggtcccgtcacggctccgaggggaagggcttggagtggatcactttcgcagaatgaaagttntggtagaaagtaaagngtacgccgcgtctggtaggaaaggggaatattcgaaccgtntacgaaaggggattacggaccttacccaaacgtaggttacgtttacgggacccttaaatttttaaaccgaaaatttcggaaagaccctaaaaccgtggaaaccggaaccccgaaaccgaacctaaaccgacgggccgttactaaacttttaaccgcggaccgaccccgaaaggggtcccgaaacgttcccggttacgggggtaaccgtccggtaattggaccttaagtttttcggaagttttaacgggg

SEQ ID NO: 400028 - DNA, 559 bp, Homo sapiens
  misc_feature: GZ8MTXP01EC27W.44.56.F01.1.454.CMB.2.raw
  modified_base (378)..(378): a, c, t, g, unknown or other
  modified_base (395)..(395): a, c, t, g, unknown or other
  modified_base (404)..(404): a, c, t, g, unknown or other
  modified_base (422)..(422): a, c, t, g, unknown or other
  modified_base (432)..(432): a, c, t, g, unknown or other
  modified_base (512)..(512): a, c, t, g, unknown or other
  modified_base (540)..(540): a, c, t, g, unknown or other
  modified_base (545)..(545): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcggagggtcgggggggggcttgggcacgagccgaggggcggtctcgtgagactctcctgtgtagtctcaggattcagtcttagtgtattatcacttggccttgggtccctcaggctccgaggggaagggcttggagtggatcactttcgcagaatggaaaacgttntggtagaaaagtaaagngtacgccgngtctggtaggaaaggganattcaccgtntacgaagggatagactcaacagtgtgactattacgaaatgagcaacctgacgacccgagacacgaggctctaattaccgngcgcgacggcacgttcggagggaactgngtcgnttagttgaagttgg

SEQ ID NO: 400029 - DNA, 712 bp, Homo sapiens
  misc_feature: GZ8MTXP01BPUHG.44.56.F01.1.454.CMB.2.raw
  modified_base (403)..(403): a, c, t, g, unknown or other
  modified_base (412)..(412): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttccttgttagttttttagaaggtgtccagtgcgaggggcgacgtgggcggagggtcgggggggggcttgggcacgaggccgaggggcggtctctgagactctcctgtgtagtctcaggtattcagtcttagtgtattatcacgttggccttggggtcccgtcgaggcctccggagggggaaggggtcttggaggtggatcactttgcagtaatgaaagttgtggtaggaaaagtaaagngtacgccgngtcgtggtaggaaagggaatattccgaaccggttctacgaaaggggtacttacggaaccttacccgaaacgtaggttcggtttacgggaccccttaaagtttttaaaccgaaaaagttcgggaaaccgaccctaaacccgtagggaaccggaacccccgaacggaaccaaccgaacggggtccttaactaattacccgttcggacccgttacccgaaggggtccgttaacgttccccggttagggggaacccttcgggaattcgggtaccttaagtttttcggaacgtttttaacggggg

SEQ ID NO: 400030 - DNA, 543 bp, Homo sapiens
  misc_feature: GZ8MTXP01A2ESC.44.56.F01.1.454.CMB.2.raw
  modified_base (368)..(368): a, c, t, g, unknown or other
  modified_base (383)..(383): a, c, t, g, unknown or other
  modified_base (405)..(405): a, c, t, g, unknown or other
  modified_base (422)..(422): a, c, t, g, unknown or other
  modified_base (432)..(432): a, c, t, g, unknown or other
  modified_base (434)..(434): a, c, t, g, unknown or other
  modified_base (454)..(454): a, c, t, g, unknown or other
  modified_base (480)..(480): a, c, t, g, unknown or other
  modified_base (488)..(488): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacaggcccaggggcggtctctgagactctcctgtgtagtctcaggattcagtcttagtgattatcacttggcctgggtccgtcaggctccgagggaggggcttggagtggatcactttcgcagaatgaaacgttnggtagaaaagtaagngtacgcgcgtctgtgaaggganttcacgtctcgaagggntgactcaacngngttggctattacgaaatgancaactgacgacccgagacacaggctntaattacngccgccgagggcagttcccgttagggcgtcgaatcggcttagtttgaagtttggg

SEQ ID NO: 400031 - DNA, 616 bp, Homo sapiens
  misc_feature: GZ8MTXP01EH4DM.44.56.F01.1.454.CMB.2.raw
  modified_base (293)..(293): a, c, t, g, unknown or other
  modified_base (397)..(397): a, c, t, g, unknown or other
  modified_base (412)..(412): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcggagggtcgggggggggcttgggcacgaggccgaggggcggtctctgagactctcctgtgtagtctcaggattcagtcttagngattatcacttggcctgggtccgtcaggctccgaggggagggcttggagtggatctactttcgcagaatggaaaccgttgtggtaggaaagtaagagtacgcgngtctgtagaaggganattcacgtctacgaagggatagactaccgaactagtgttggacctaagtttaacaaagtggtaacgacgtaaaccgtacggaacgaaccccggaacgaaccgaacgacggtccgtactacttaccgtcggccgccgacggcgtaacgtcccgttaggggccgttccgtaagtgtctagtttgagttaaggtttgggggaaccgg

SEQ ID NO: 400032 - DNA, 578 bp, Homo sapiens
  misc_feature: GZ8MTXP01APDNR.44.56.F01.1.454.CMB.2.raw
  modified_base (242)..(242): a, c, t, g, unknown or other
  modified_base (422)..(422): a, c, t, g, unknown or other
  modified_base (566)..(566): a, c, t, g, unknown or other
  modified_base (572)..(578): a, c, t, g, unknown or other
tcagacagtatatacacgaccggtgctcgatttagcagacgtctgtcggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaaggccgattcatcatctccagagacaatgtacgaaaacacggtntatttacaaatgaacagtctaaagagtcgaggacacggctgtctactattgtgtgagacctttatgatttcacttgggggagtttatcgtttgggcccacgacgtgggggccaggggaaccctttgggtccgtcgtctccctcaacgcttccaccaagggcccatcggtctccccgtgcnccctgctccaggagccaccgtcgtgggggccacgacggccggccccgtggggggccttggcccgtcgggtccaagggtacccttacctttccctaattactaacctgttcctggacggcggggtccttgggacaagggcccganacgtgnnnnnnn

SEQ ID NO: 400033 - DNA, 580 bp, Homo sapiens
  misc_feature: GZ8MTXP01BS96R.44.56.F01.1.454.CMB.2.raw
  modified_base (391)..(391): a, c, t, g, unknown or other
  modified_base (440)..(440): a, c, t, g, unknown or other
  modified_base (523)..(523): a, c, t, g, unknown or other
  modified_base (531)..(531): a, c, t, g, unknown or other
  modified_base (552)..(552): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcggggggggcttgggcacaggcccgaggggcggtctctgagactctcctgtgtagtctcaggattcagtcttagtgattatcacttggccttgggtcccgtcaggctccgagggggaaggggcttggagtggatcactttcgcagaatggaaacgttgtggtaggaaaagtaagngtacgccgcgtctggtaggaaagggatattcgaccgttcacgaaggggntagactaccaagagttgttacggacctaagtttaacaaattggaagaccaaacctggaaccgacccgaacgacacgaggcctnaatttacnggccgccgagggcagttccgngggaactcggaatgcttatttgaattgg

SEQ ID NO: 400034 - DNA, 602 bp, Homo sapiens
  misc_feature: GZ8MTXP01EKGQ5.44.56.F01.1.454.CMB.2.raw
  modified_base (317)..(317): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggagggcgacgtggcggagggtcgggggggggcttggcacgagccgagggcggtctctgagactctccgtgtgtagtctcgaggattcagtcttagtgattatcacgttggcccttgggtccgtnaggctccgaggggagggctttggagtggatcacgttttcgtacagaaatgaaaaccgttgtaggtaggaaagtaagaagttacgccgtcgtcgtagtagaaaggggatacttcaccgtctacgaagggatagacgtaccgaactaagttgtggacctagtttaaacaaagttaggagacaaccgtagaacgacccgacgacaacgacggtcgtactactactgcgcgacgcgactccgttacgggcgttcgaatgtctagttgagttaagttttcggggaaccgg

SEQ ID NO: 400035 - DNA, 696 bp, Homo sapiens
  misc_feature: GZ8MTXP01D4FA2.44.56.F01.1.454.CMB.2.raw
  modified_base (376)..(376): a, c, t, g, unknown or other
  modified_base (394)..(394): a, c, t, g, unknown or other
  modified_base (424)..(424): a, c, t, g, unknown or other
  modified_base (597)..(597): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgattttccttgttagttttttagaaggtgtccagtgcgaggggcgacgtgggcggagggtcgggggggggcttgggcacgagccgaggggcggtctctgagactctcctgtgtagtctcaggattcagtcttagtgtattatcactttggcctgggtcccgtcaggctccgaggggaagggcttggagtggatcactttcgcagaactgaaaacgttntggtaggaaaagtaaagngtacgccgacgtctggtaggaaaggggaanattcgaaccggttcgtacgaaaggggattacggaaccttacccaaacgtaaggttggtttagggacccctaaagtttttaaccaaaaagtttggaaacgaccaaaacccgtgaaaccggaacccccggaacggaacctaaccgaggggtcccgttccttaaagttttaaccgngggtaccccgcccgaaaggggtcccgttaacgttccccggttagggggaaccgtttaccgggaatttgggaccttacgtttaacgttaagtttaagggg

SEQ ID NO: 400036 - DNA, 760 bp, Homo sapiens
  misc_feature: GZ8MTXP01CMIGQ.44.56.F01.1.454.CMB.2.raw
  modified_base (284)..(284): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcgggagggtcggggggggggcttgggcacgaggccgaggggcggtctcgtgagctctcctgtgtagtctcgaggtnttcagttcttagtgtattatctacgttggcctggggtccgtcgaggccgtaccggagggggtaacgggggtctttagggaggttggtaacttcgtaccgtttttcgacgtaaggtaaagttaggtaaaaccgttaggtaggggtaagggtaaaagtaaaacggaaacgggttaccggccggtacggttacgtagggtacgggaaagggggaatacgttaccgacccgttataacggaaaggggtactacggaaccctacgaaacgttaggttcggttacggacccttaaagttttaaaccgaaaagttcggggaaaccggtaaccctaaaccgtcgggaaacccgaaaccccgacggaaacctaacggcgggtaccgttacctaagtttacgcggacgcccggaaggccgtaacgtccggttacgggggccttaggaatcgaacttaggtttgacgtttaagggttcggggaacgg

SEQ ID NO: 400037 - DNA, 540 bp, Homo sapiens
  misc_feature: GZ8MTXP01A6K89.44.56.F01.1.454.CMB.2.raw
  modified_base (383)..(383): a, c, t, g, unknown or other
  modified_base (406)..(406): a, c, t, g, unknown or other
  modified_base (416)..(416): a, c, t, g, unknown or other
  modified_base (425)..(425): a, c, t, g, unknown or other
  modified_base (488)..(488): a, c, t, g, unknown or other
  modified_base (495)..(495): a, c, t, g, unknown or other
  modified_base (498)..(498): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcggggggggcttgggcacagccaggggcggtctctgagactctcctgtgtagtctcaggattcagtcttagtgattatcacttggcctgggtccgtcaggctccgagggaaggggcttgagtggatcactttcgtcagaactgaaacgttatggtaggaaagtaaagngtacgccgcgtctgtgagggaanattcaccgtntcgaagggntgactcaacagtgttaggctaatttacaaatgagacaacctgagacccgacgacacagggctntaattcngcnccgaggcagttccgttgggaactcgaatgcattgaattaagg

SEQ ID NO: 400038 - DNA, 754 bp, Homo sapiens
  misc_feature: GZ8MTXP01B6C2T.44.56.F01.1.454.CMB.2.raw
  modified_base (421)..(421): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcggagggtcgggggggggcttgggcacgagccgaggggcggtctctgagactctcctgtgtagtctcgaggtattcagtcttagtgtatttatctacgttggccttggggtcccgtcgaggccgtccgaagggggaaggggtcttggagtggattcgtactttcgacaagtaataggtaaacgtttgtagggtaggaaaaagttaaagnggtaccggccggtcggttacgtaggtaggaaagggggaatactttaccgaccggttctacggaaaggggtactacgggaaccttaccgaaagtagggttgtttacgggaacccttaaagtttttaaaccgaaaagtttggaaacgtaccctaaaacccgtgggaaacccgaacccccggaaacggacccaaccggtacggggtacccttacttaaacgttacccgttgggacccgacccgaaagggggtcccttaacgtttccccgggaggggggtaaaccctttccgggaattcgggaccctttagttttaacgggaaagtttttccggggg

SEQ ID NO: 400039 - DNA, 580 bp, Homo sapiens
  misc_feature: GZ8MTXP01BRRQK.44.56.F01.1.454.CMB.2.raw
  modified_base (453)..(453): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggttgtccaggtgcgaggggcgacgtgggcggaggtcgggggggggcttgggcacgagcccaggggcggtctctgagactctcctgtgtagtctcaggattcagtcttagtgtattatcacttggcctgggtccagtcaggctccgagggagggcttggagtggatcactttcgcagatagtaaacgttagtggtaaggaaagtaagagtaccgccgcgtcgtaggtgaaagggagtagttcaccgtctacgaagggatgactcaacgngtagtgacctaagtttaacaaagtgagacaaccgtgaacgacccgagacacacgggctctaattacgtgccgccgaaggccgattccccggtaagggggaccttcgagttcggacttggtttgtaag

SEQ ID NO: 400040 - DNA, 573 bp, Homo sapiens
  misc_feature: GZ8MTXP01CNIKP.44.56.F01.1.454.CMB.2.raw
  modified_base (383)..(383): a, c, t, g, unknown or other
  modified_base (406)..(406): a, c, t, g, unknown or other
  modified_base (442)..(442): a, c, t, g, unknown or other
  modified_base (453)..(453): a, c, t, g, unknown or other
  modified_base (475)..(475): a, c, t, g, unknown or other
  modified_base (486)..(486): a, c, t, g, unknown or other
  modified_base (492)..(492): a, c, t, g, unknown or other
  modified_base (498)..(498): a, c, t, g, unknown or other
  modified_base (532)..(532): a, c, t, g, unknown or other
  modified_base (542)..(542): a, c, t, g, unknown or other
  modified_base (547)..(547): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcggaggtcgggggggggcttgggcacgagccgagggcggtctctgagactctcctgtgtagtctcaggtattcagttcttagtgtattatcacgtttggccctgggtcccgtcgaggctccgaggggagggtcttggagtggattcacgttttcgcaagtaatgtaaaccgttanggtagaaagtaagaagtacgcgngtcgtgtaggaaggagtatcacgtctacgaagggtntgactcaacgngttgtgactattacaaatggancacctggaacncccganacacgnggtctactactcgcgcgcgacgcgtacgtccggnggcgttacgntcgtnttagttgagttaaggttcggggaacg

SEQ ID NO: 400041 - DNA, 858 bp, Homo sapiens
  misc_feature: GZ8MTXP01A9ZJH.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagtttttagaaggtgtccagtgcgagggcgactggcggaggtcggggggggcttggcacagccgagggcggtctctgagactctcctgtgtagtctcaggattcagtcttagtgattatcacgtttggccgttgggtcccgtcgaggtcctaccggagggggaacggggtcttggacggttggtacttaccttacgttttcgtacgtaaggtaagttacggtaaaacgtttaggtaggggttaaggggtaaaaaaagggttaaaaacgggtaacgggttaaacccgggtcccgggtaccggtttacgttaggggttaaggggaaaacggggggtaaatacgttttaacccgaccccggttacgttacggaaaaggggtacgtttaaccggaacccttaacccgaaaccggtaacggttggtttaccgggaacccctttaaagtttttaaaccggaaaagtttcggggaaaacctaaccccgtaaacccgttaggaaaccccggtaaacccccggaaacgggtaccctaaacgggacccgggtaccggtttaccttaaacgtttcccgttacgggccccggttacccggaaaggggtccccggttaacgttccccgggttaggggggtaacccttccggaagttcgggtaaccttaaggtttttaacgggaagtttttaaccggggg

SEQ ID NO: 400042 - DNA, 729 bp, Homo sapiens
  misc_feature: GZ8MTXP01AIHNQ.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcggagggtcgggggggggcttgggcacgagccgaggggcggtctcgtgagactctcctgtgtagtctcaggattcagtcttagtgtattatcacgtttggcccttggggtcccgtcgaggcctccgagggggaaggggtcttggaggtggactcgtactttcgacaggtaactaggaaacgtttagtggggtaggtaaaaaggtaaagcggttaacgcccggtcgtcgtagggtaggaaaggggtaaactacgtttccgaaacccggttcgtaaccggaaaggggtacttacggaacctaccccgaaaacgtagggttacgtttacgggacccttaaaggttttaacaaaaagttggaaccgactaaacccgaggaaccgaaccccgaacggaccaaccggtagggccccgttataacgtttaccgttggcccgacccgggaagggccgaaccgttcccggagggggtaacccgtagggtaactgggtaccttagtttaaggaacgttttaaggggg

SEQ ID NO: 400043 - DNA, 531 bp, Homo sapiens
  misc_feature: GZ8MTXP01A5FOI.44.56.F01.1.454.CMB.2.raw
  modified_base (362)..(362): a, c, t, g, unknown or other
  modified_base (400)..(400): a, c, t, g, unknown or other
  modified_base (410)..(410): a, c, t, g, unknown or other
  modified_base (418)..(418): a, c, t, g, unknown or other
  modified_base (427)..(427): a, c, t, g, unknown or other
  modified_base (479)..(479): a, c, t, g, unknown or other
  modified_base (482)..(482): a, c, t, g, unknown or other
  modified_base (496)..(496): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcggggggggcttgggcacagccaggggcggtctctgagactctcctgtgtagtctcaggattcagtcttagtgattatcacttggcctgggtccgtcaggctccgaggggaggggcttgagtggatcactttcgcagaatgaaaccgttntggtaggaagtaagaagtacgcgcgtctgtgaaggganattcaccgtnacaagggntgactcaangtgtgctattacaatggagcaacctgacacccgagacacgagtctatattcngcncgaggcgagtccgngggcttcgaatgctagttgattggttcggggaacg

SEQ ID NO: 400044 - DNA, 824 bp, Homo sapiens
  misc_feature: GZ8MTXP01CFTY8.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttccttgttagtttttagaaggtgtccagtgcgaggggcgacgtgggcggaggtcggggggggcttggcacgagccaggggcggtctcgtgagactctccgtgtgtagtctcaggtatcagtcttagtgtattatctacttggcctttggtcccgtcgacggtcctcccggaagggggaagggggtcctttggaggttgggtattccgtacgttttcgactaaggtaaagtacggtaaaacgtttagtagggtaaggtaaaaagttaaaggcggtaacggacccggtcgttaccgtagggtaaggaaaggggtaactactttccgaaacccggttctaacggaaaggggtactcgggtaaaccctccgaaaagtcggttggtttacggacccttaaagtttttaaaccaaaagtttcgggaacgaaccccgtaaaaccgttcgggaaaacccggaaccccccggtaaacggaaacccgtaaaccgggaacgggtcccggtttaacccttaaaacgtttttaccccggcggtaccccgggaaccccggaaagggggtccccgttaaacggttccccccgggggtttaggggggaaaccccgtttggaaagttttcccgggactttaaaaggttttttcgggaaacgttttttaacgggggggg

SEQ ID NO: 400045 - DNA, 580 bp, Homo sapiens
  misc_feature: GZ8MTXP01E0T6J.44.56.F01.1.454.CMB.2.raw
  modified_base (387)..(387): a, c, t, g, unknown or other
  modified_base (515)..(515): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtcagtgcgaggggcgactggcggaggtcggggggggcttgggcacagccaggggcggtctctgagactctcctgtgtagtctcaggattcagtcttagtgatatcacttggcctgggtccgtcaggctccgaggggaaggggcttgagtggatcactttcgtcagtaataggaaaacgttatgggtaggaaaagtaaagngtacgccgcgtctggtaggaagggaagattcaccgtctcgaagggatagacttccaaacagtgttggacctaagttttaacaaattgaacgcaaacctgaacgaccccgaacgacaccgaggtccgtntaattacttgccgcccgaggcgacgttccgttgggccgtgaatggcttagtttgaagtttaaggg

SEQ ID NO: 400046 - DNA, 658 bp, Homo sapiens
  misc_feature: GZ8MTXP01APNLC.44.56.F01.1.454.CMB.2.raw
  modified_base (596)..(596): a, c, t, g, unknown or other
  modified_base (603)..(603): a, c, t, g, unknown or other
  modified_base (624)..(624): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttccttgttagttttttagaggtgtccagtgcggaggggcgacgtgggcggagggtcggggggggcttgggcacgagccgaggggcggtctcgtgagactctcctgtgtagtctcgaggtattcagtcttagtgtatttatctacgttcggccgttggggtcccgtcgacggccgtaccggagggggaaggggtcgttaggaggttggtacttccgtacgttttcggactaaggtaattaggtaaacgtttagtaggggtaaggtaaaaaggtaaaggtcggtaaccggccggtcggttacgtagggtagggaaaggggaatacttacgaccgtgtacgaaagggtatacgactaccaagtggttcgttcggaccttaagtttaacgaaagttgaacgacctaaccgtgaacgaccccgagacacgaggtcctntaatcgngcgccgagggcacgttccggngggaactcgtaagtggattagtttgaagtttggg

SEQ ID NO: 400047 - DNA, 587 bp, Homo sapiens
  misc_feature: GZ8MTXP01E0FMA.44.56.F01.1.454.CMB.2.raw
  modified_base (193)..(193): a, c, t, g, unknown or other
  modified_base (226)..(226): a, c, t, g, unknown or other
  modified_base (237)..(237): a, c, t, g, unknown or other
  modified_base (482)..(482): a, c, t, g, unknown or other
  modified_base (496)..(496): a, c, t, g, unknown or other
tcagacagtatatacacgaccggtgctcgatttagcagacgtctgaacacacaaaggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctctgcactgganccagcgtaatnttcttagtcttaactttgtctcctggtatcaacatcatccaaggtaaaccacccccaaatcatcatctatgaggactaagtaagacggcccttgtaggggtttactaagtcccgtcttcactcgccctaaccaacgtcccggactaaaccgaccggccctccgtacgactaaactcctcgtcgggcctcgagcgtaggaggtacgaggtctgtaattattatttgggtgtctcagtatgttcgtnctatactaactttntggttcgttacgggaagtcgggaaccgtaaaggtcccaccggttcttacggtcacgaaccccgaacggaccccaacccgtaattcgtaacc

SEQ ID NO: 400048 - DNA, 740 bp, Homo sapiens
  misc_feature: GZ8MTXP01CMTFK.44.56.F01.1.454.CMB.2.raw
  modified_base (412)..(412): a, c, t, g, unknown or other
  modified_base (426)..(426): a, c, t, g, unknown or other
  modified_base (471)..(471): a, c, t, g, unknown or other
tcagacagtatatacacgaccggtgctcgatttagcagacgtctgaacacacaaaggggagctctgggagaggagccccagccgtgggattcccaggagtttccacttggtgatcagcactgagcacagaccaccaaccatggagtttgagctaatcttgtattttccttgttagtttttagaggtgtccagtgcgagggcgacgtgggcggagggtcggggggggggcttgggcacgagccgaggggcggtctcgtgagactctcctgtgtagtctcgaggattcagtcttagtgattatctacgtttggccttggggtcccgtcgagggcctccgagggggaaggggtcttggagttggatcgactttcgcagtaatggtaaacgtttgtagggtaggaaaagttaaagnggttaacgcccggnggttacgtggtagggaaaggggaaagtactttacgaacccggttntacggaaaggggtatggaacccttaccgaaacgtaggttgttacgggaccctaagttttaaccgaaaagttgggaaccgtaccctaaaaccgttcggaaacggaccccccgaaggaacccaacgaacggggtccttacgttaaactttaaccgcggaaaccccggttcccgaaagggggtcccgttaccgttacccggggttcgggggtaaccgtcccggtaagttcgggtaccttaaaggtttttccgggaaagtttttaaccggggg

SEQ ID NO: 400049 - DNA, 606 bp, Homo sapiens
  misc_feature: GZ8MTXP01A3ZFN.44.56.F01.1.454.CMB.2.raw
  modified_base (599)..(605): a, c, t, g, unknown or other
tcagacagtatatacacgaccggtgctcgatttagcagacgtctgtcgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtacgaaaacacggtgtatttacaaatgaacagtctaagagtcgaggacacggctgtctactattgtgtgagtacctttatgtatttcgacgtttggggggatttagtcgtttgggcccacgacgttggggcagggaccttggtcgtcgtctcctcaacgcttccgaccaagggccccacgtccgggtccttcccccgtggcccgtcccctgcctcccgaggacgccgtaccttcgcgggggccaacgcggccggccccgttggggggccttgggcccgttgggtaccaaacgggtcccttacgttaccttattaaccgtactcggttcctaaggcggccggggtcttcgggaccgaagggcgcagtaagnnnnnnng

SEQ ID NO: 400050 - DNA, 731 bp, Homo sapiens
  misc_feature: GZ8MTXP01CU4M0.44.56.F01.1.454.CMB.2.raw
tcagacagtatatacacgaccggtgctcgatttagcagacgtctgaacacacaaaggggagctctgggagaggagccccagccgtgagattcccaggagttccacttggtgatcagcactgagcacagaccaccaaccatggagttggctaatcttgtattttcttgttagttttttagagtgtcagtgcggagggcgacgtgggcgggaggtcggggggggcttggcacgagccgaggggcggtctcgtgagtactctcctgtgtacgtctcgaggtattcgagtcttagtgtattatcgtacgttcgggtccttgggtcccgtcgacggtccgtaccgggagggggtaaggggctttaggaggttgggtacttccgtaacgtttcgacgtaaggtaacgttaaggtaaaacgtttagtaggggtaaggtaaaaaaggttaaaggcggtaacccggtccggtacggttacgtagggtagggaaaagggggtactacgtttacccgaaccggttacgttaacggaaagggggtaactacgggtacctaccgaaacgttggttcggttaggaacccttaagttaacgaaagtcgtaaacgcctaaacgcgaaccgtacccgaacgacgaacgtacggtctacgttaattacgcggcccacggacggtcgttaacgttccggttaggggtaaccgacgtaagtcgattaggttttaacgaaggtttaacgggg

SEQ ID NO: 400051 - DNA, 588 bp, Homo sapiens
  misc_feature: GZ8MTXP01CRJTP.44.56.F01.1.454.CMB.2.raw
  modified_base (282)..(282): a, c, t, g, unknown or other
  modified_base (414)..(414): a, c, t, g, unknown or other
  modified_base (420)..(420): a, c, t, g, unknown or other
  modified_base (446)..(446): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagttgggctaatcttgattttccttgtagtttttttagaaggtgtccagtgcgaggggcgactggcggagtcgggggggggcttggcacagccaggggcggtctctgagactctcctgtgtagtctcaggattcagtcttagngattatcacttggcctgggtccgtcaggctccaggggaaggggcttgagtggatcactttcgtcagaatgaaaccgttatggtggaaagtaaagaacgtacgccgcgtctgtgaagggaagatcaccgtcanaaggangacacacagtgtgtcacttactaaanagagacaacacgacgaccgaccgacaaccacgtcgtacgtacttactaacgtcgccgaccggacggacgtaccgttcgggttacgggttaccggtaacgtacgtaacgtagttacgttagttaagtttaaggggttaacggg

SEQ ID NO: 400052 - DNA, 782 bp, Homo sapiens
  misc_feature: GZ8MTXP01D09T2.44.56.F01.1.454.CMB.2.raw
  modified_base (290)..(290): a, c, t, g, unknown or other
  modified_base (631)..(631): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttccttgttagttttttagaaggtgtcagtgcggaggggcgacgtgggcgggagggtcgggggggggcttgggcacgaggccgaggggcggtctcgtgagtacctctcctggtgttagtctcgaggtnttcagtcttagtgtattatccgtactttggccttggggtcccgtcgacgggccttccggaaggggggtaacgggggtctttagggaggttgggattcctaacgttttcggacaaggtaaactagggtaaaacgtttagttagggggtaaggggtaaaaaagttaaaaggtcgggttaaccggcccgggtaccggttacgttaggggtaggggtaaaagggggaaacttagttacccgacccggttacaacggtaaaggggattacggaccttacccgaaagtggttacgttacgggaacccttaagttttaaacgaaaagttgaaacgtacctaaacccgnggaaaccggacccccggaaagacccgtaacggtacgggtccttacttaaactttcgcggacccgacccgaaagggggtcccttaacgttcccggggttagggaacccgtcgtaagttcggtcttaaggtttttcgaacgtttttaaggggg

SEQ ID NO: 400053 - DNA, 581 bp, Homo sapiens
  misc_feature: GZ8MTXP01CTNOF.44.56.F01.1.454.CMB.2.raw
  modified_base (361)..(361): a, c, t, g, unknown or other
  modified_base (391)..(391): a, c, t, g, unknown or other
  modified_base (402)..(402): a, c, t, g, unknown or other
  modified_base (413)..(413): a, c, t, g, unknown or other
  modified_base (424)..(424): a, c, t, g, unknown or other
  modified_base (503)..(503): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaggtgtccagtgcgagggcgacgtggcggaggtcggggggggcttggcacgagccgagggcggtctcgtgagactctcctgtgtagtctcaggtattcagtcttagtgattatctacttggccttgggtcccgtcgaggcctccgaggggagggtcttggagtggatctacgtttcgnagaatagaaagttgtggtagaaaagtaagngtacgcgcgtngtagaaggganattcgaccgtntacgaagggatgactcaagtagtgtgcctagtttacaaatgacgacaaccgtgacgaacccgacgacacgacggtcgtntaacgtacttggccgccgaaggtccgaacgttccggacggggccgtcgaagtcgtcgttaagtttggaagtttaaggg

SEQ ID NO: 400054 - DNA, 755 bp, Homo sapiens
  misc_feature: GZ8MTXP01BHETR.44.56.F01.1.454.CMB.2.raw
  modified_base (284)..(284): a, c, t, g, unknown or other
  modified_base (558)..(558): a, c, t, g, unknown or other
  modified_base (680)..(680): a, c, t, g, unknown or other
  modified_base (699)..(699): a, c, t, g, unknown or other
  modified_base (704)..(704): a, c, t, g, unknown or other
  modified_base (732)..(732): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtatttcttgttagtttttagagtgtcagtgcggagggcgacgtgggcgggaggggtcggggggggcttgggcacgacgccggaggggtccggtctcgtgagtctctcgtgtgtagtctcgaggtnttcgagtcgttagtgtaattatctacgttcggtccgtgggtcccgtcgacggtcctaccgggaaggggggtaacggggtcgttaggtacgggttgggtacttacccgttaacgttttccggtaacgtaaggtaaagttaacgggttaaaaacgtttagggtaggggtaaagggtaaaaaaagttaaaacgggtcgggtaaaccggcccgggtacgttacggttaggggtaacggggtaaaaggggtaaacttccgttacccgtaacccgggttnttaaacgggaaaggggtcttaaccggaacccttaaccgaaagtgggttcgtaccggaactttaaagtttaaacgaaagttcggaactaccaaaccgtgaaacccggaccaacgacaacgggnggtccttacgtaattccgnggccncgaagggccttacgttcggaggaactgntggcttagtttcgaaggttcggg

SEQ ID NO: 400055 - DNA, 742 bp, Homo sapiens
  misc_feature: GZ8MTXP01B9AAA.44.56.F01.1.454.CMB.2.raw
  modified_base (278)..(278): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagttggctaatcttgtattttccttgttagttttttagaaggtgtccagtgcggagggcgacgtgggcggagggtcggggggggggcttggcacgagccgagggcggtctcgtgagctctcctgtgtagtctcgaggtnttcgagttcttagtgtattatccgtacttcgggcctggggtcccgtgaggccgtacccggagggggaacgggggctttaggaggtggattcgtactttcgacaagtaataggtaaaccgtttagtagggtaggaaagtaaaggaacggttaccgccggtcgtcgtagggttagggaaaggggtaagtacttaccgacccggttactacggaaaggggatacggaacctacccgaagtagttcggttacggacctaagtttaacaaaagttcgggaacgtacctaaaccgtacggaaccgaaccccggaacgaaccgaacgacgggtccgttacttaacgttaccgtcggaccggttaccccgagggttcccggtaacttcccggggttacggggttacccgttacggtaagttaccggtcgttaagttttgggaagttttaacggggtttcggggggaacccgg

SEQ ID NO: 400056 - DNA, 777 bp, Homo sapiens
  misc_feature: GZ8MTXP01ARNFN.44.56.F01.1.454.CMB.2.raw
  modified_base (293)..(293): a, c, t, g, unknown or other
  modified_base (540)..(540): a, c, t, g, unknown or other
  modified_base (645)..(645): a, c, t, g, unknown or other
  modified_base (742)..(742): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgagccgaggggccggtcctcgtgacgtctctcgtgtgtacgtctcgaggtntctagtcttagtagtattactctacgtcggtccgttcgggtcccgtcgacggtccgtaccgggaagggggtaacgggtcgttaggtagggtaggtactaccgttaacgtttcggacgtaaggtaacgttaacggttaaaacgttaggtaggggtaaaggtaaaaaaggtaaacggtaacggtacccggacccgggtcgtacgtagggtaagggaaaggggtaaattccgttacccgaccccggttanaaacggggaaagggtctaaccggaccccttaaacgaaacggttagggtttccggtaaccgaacctttaaatttaaacggaaattcgggaaccaacccctaaacgngggaaaccccgaaccccgggaaagactacgggcggttaccttactaagttcgcgggacccttcgggaacggtcttccggttccggggagggtaaccngtcgtcgtagtttagttaaggttaacggttcgggg

SEQ ID NO: 400057 - DNA, 808 bp, Homo sapiens
  misc_feature: GZ8MTXP01DZNJE.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctatcttgtattttcttgttagtttttagaggtgtcaggtgcggaggggcgacgtgggcggagggtcgggggggggcttgggcacgaggccgaggggccggtctctgagactctcctgtgtagtctcaggtattcagtcttagtgtattatctacgtttcggcccgttggggtcccgtcgacgggtcccgttacccggaaggggggtaacgggggtcttagggtaggttgggtacttccgtaacgttttcggactaaaggtaaagttaggtaaaacggtttagtaggggtaaggtaaaaaagttaaaggtaacgggtaccgtacccggtcggtacgtaggggtaagggaaagggggtaactacgtttaccgaaacccggttcgtaaggaaacggggtattacggaaccttacccgaaaagtggttacggttacggaaccctttaaagttttaaaccggaaaagttcggggtaaaccaacccgttaaacccgtcggaaacccggaaccccgaaaccggaaccaaccgtacggggtaccttacccttaaagttccgttcgggacccgttccgaaacgggggccttaaccggttcccggttagggggtaacccgtcgtaagttccgggatttaagttttcgggttaacgttttaacgggggg

SEQ ID NO: 400058 - DNA, 911 bp, Homo sapiens
  misc_feature: GZ8MTXP01AZV7J.44.56.F01.1.454.CMB.2.raw
  modified_base (284)..(284): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcggagggtcgggggggggcttgggcacgagccgaggggcggtctcgtgagactctcctgtgtagtctcaggtnttcagtcttagtgtattactctacgttcggccgttcgggtcccgtcgacggtccgtaccggaagggggtaacggggtcgtttaggaggttggtactacgttacgttttcggtacgtaaggtaaacgttacggtaaaacgtttaggttaggggtaaagggtaaaaaaagggttaaaacgggtaacggttaacccgggtaccccgggtacggttacggttaggggtaacggggtaaaagggggtaaacttacgttttaaccccggaacccgggtttaccgtaaaccggggaaaagggggtactttaacgggaaacccctttaacccggaaaaccgggttaggtttacggggtttaaccgggaaccctttaaacggttttaaaaccgaaaaggtttacggaaccgtaaccccgtaaaacccgtcgggaaaccccgtaaacccccgggaaacgaaacccgtaaccgggtaccgggttccgttaaacccttaaagtttaacccggcggaccccgggttaccccgaaagggggtcccccgttaacgtttcccccgggaagggggtaaccccgttcgggtaattcgggtaaccgttttacggttttaaggttaaaccgggtttttaacgggggg

SEQ ID NO: 400059 - DNA, 880 bp, Homo sapiens
  misc_feature: GZ8MTXP01DKKXB.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttcttgttagttttttagaggtgtcagtgcggagggcgacgtgggtgggagggtcgggggggggcttgggcacgagccgaggggcggtctcgtgagtactctcctgtgtagtctcaggtattcagtcttagtgattatctacgtttggccttggggtccccgtcgaaggtccgttccccggaaggggggtaacgggggtctttgggaagggtttgggaacgtttccgtaaccgttttttccggtacaaaggttaaaacttagggtaaaaaccggttttagtaggggggttaagggtaaaaaaaacgggttaaaaaggaacgggttaacccgggaccccgggtacgggttaccgttagggtagggaaaacggggggtaaagtactttaccgaaccggttcgtaccggaaaggggtactacggaaccttaccaaacgtagttcggttacggaacccttaaagtttttaaaccaaagtttcggaaacgtacccgtaaaacccggttcgggaaacccggaaacccccggaaaaccggaaccgttaaacccggaaacgggggtccccgtttaacctttaaacggtttaaccgttccggggtaccccgttaccccgggaaagggggtccccggttaacgtttcccccggggttagggggtaaccccggttacggtaagttcgggtacctttaaggtttttcgggaaacggtttttaacggggg

SEQ ID NO: 400060 - DNA, 802 bp, Homo sapiens
  misc_feature: GZ8MTXP01BC6BV.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgagggcgacgtggcggagggtcgggggggggcttggcacgaggccgaggggcggtctcgtgagactctcctgtgtagtctcaggattcagtcttagtgattatcacttggcctgggtcccgtcgaggccgtaccgagggggaacggggtcttggaggtggaattcctacgtttcgactaagaacgttaggtaaaacggtttagtaggggtaaggtaaaaaggttaaaaggtaacggttaacccgggcccgggtacggtttacgttaaggggttagggaaaacgggggtaaataccgtttaccgaacccggttacgtacggaaaagggggtctacgggaacccttacccgaaacggtagggtttgttacgggaccccttaaagttttaaacccgaaaagttgggaaacgacccctaaaacccgtcgggaaaaccccggacccccggaaacggtaaaccaaccggtaacgggtccggtttactaaacgtttaccgccggtccccgggacccgtaacgggggcttaacccggtttccccggttaggggggaaccctttccggaactttggggacccgtttagttttaaggaaccggttttaagggggg

SEQ ID NO: 400061 - DNA, 622 bp, Homo sapiens
  misc_feature: GZ8MTXP01AW2X8.44.56.F01.1.454.CMB.2.raw
  modified_base (294)..(294): a, c, t, g, unknown or other
  modified_base (423)..(423): a, c, t, g, unknown or other
  modified_base (449)..(449): a, c, t, g, unknown or other
  modified_base (459)..(459): a, c, t, g, unknown or other
  modified_base (554)..(554): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcggagggtcgggggggggcttgggcacgaggccgaggggcgtctcgtgagactctctgtgtagtctcaggtattcagttcttagngtaattatcgacttggcctggggtcctcgaggcctaccggagggggaaggggtctttaggagtggatcgtacgttttcgacagaattaggtaaaaccgttgtaggtaggaaagtaaaggagtacgccgngtctggtagaagggatattcaccgtntagaacgggntacgactacccgaatagtgttacggacctaatttaacgaaatagggaacgtacaaccgtagaccgacccgacgacacgacgtcgtactattacgngccgccgaggcgtacgtccggttggcgttcggaatcggtctagttggagttcggtttcggggaaccgg

SEQ ID NO: 400062 - DNA, 712 bp, Homo sapiens
  misc_feature: GZ8MTXP01DUJK1.44.56.F01.1.454.CMB.2.raw
  modified_base (630)..(630): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggttgtccagtgcggaggggcgacgtggcggagggtcggggggggcttgggcacgaggcccgaggggccggttctcgtgagactctcctggtgtagtctcaggtattcagtctttagtgtatttaatctacgttggcctgggtcccgtcgaggctccgaggggaagggtcttggacgtggtattcctacgtttcgcgaagtaactaggtaaacgtttagtggggttaggaaaaagttaaagcggttaaccgccggtacgttcgtggtaggaaaggggtaatctttaccgaccggttcgacgtaaaggggcttacgaccttaccaaacgtaggttgttacggaccttaagttttaaccgaaagtttggaaacctccgaaaccgtagaaccggaacccccggaaagtaccgaccggtaacgggtcccgttaacttaaacggtttccnggggaccccgttccgaggggtccaacgttccgggttacggggtaacctcgtaattggacttagttttgaacgttttaagggg

SEQ ID NO: 400063 - DNA, 753 bp, Homo sapiens
  misc_feature: GZ8MTXP01C5ROT.44.56.F01.1.454.CMB.2.raw
  modified_base (278)..(278): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttcttgttagtttttagaggtgtcagtgcggagggcgacgtgggcggagggtcgggggggggctgggcacgagccgaggggcggtctcgtgagactctcctgtgtagtctcaggtnttcagtcttagtgtattatctacgttcggccttggggtccctcgaggccgtccggaagggggaagggggtcttggaaggttggactttcgtacttttcggacaaggtaaacttggtaaaacgtttgtaggggtaaggtaaaaaacgttaaaggcggtaccggcccgtacggttcgtggtacgggaaagggggaactacgtttccgaacccgttcgacgtaaaggggtactaacggtaaccttacccgaaacgtaaggttggttacggaaccctttaagttttaaaaccgaaagttcggaaacgtaaccctaaacccgtggaaaccccggaccccggaaacggaacccaaccggtaggggtcccttcgttaaaacgtttcgcggaccccgaccggtaaacgggccgttaaccgtttcccggagggggtaacctacggaattcgggacctttaagttttggaacgttttaacggggg

SEQ ID NO: 400064 - DNA, 732 bp, Homo sapiens
  misc_feature: GZ8MTXP01AMYDT.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgattctcttgttagttttttagagtgtccagtgcggaggggcgacgtgggcggagggtcggggggggcttgggccacgagccgaggggccggtctcgtgacgacctctcctgttgtagtctcgaggtattcagttcttagtgattatcgtacgttcggcccgtggggtccccgtcgacggtccgtccggaagggggtacgggggtctttagggaggtgggtatccgtacgttttcgacaacggtaaataggtaaaacgtttgtaggggtaaaggaaaacggtaaggaggttacccggacccggtcggttacgtagggtaacgggaaaggggaagtattaccggaccgttacgtaacggaaggggtactacgggtaacctaccgaaacgtaggttcggttacgtaacctaaagttttaaccgaaaagttcgaaacgtaccgaaaccgtcgaaccggaaccccggaacgtaaccgaaccggtagtacccggttaataagtttccgaggccgaacgaacggcgttaacgttcccgggttaaggggaccctggtaacgtgttacgttgtttggtaagg

SEQ ID NO: 400065 - DNA, 704 bp, Homo sapiens
  misc_feature: GZ8MTXP01ACLXG.44.56.F01.1.454.CMB.2.raw
  modified_base (289)..(289): a, c, t, g, unknown or other
  modified_base (618)..(618): a, c, t, g, unknown or other
  modified_base (641)..(641): a, c, t, g, unknown or other
  modified_base (655)..(655): a, c, t, g, unknown or other
  modified_base (683)..(683): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttccttgttagttttttagaaggtgtccagtgcggagggcgacgtgggcggagggtcgggggggggcttgggcacgaggcccgaggggccggtctcgtgagtacctctcctgtgtagtctcaggtnttcagtcttagtgtattatctacgttcggcctggggtccctcgacggtctacccggagggggaaggggtctttaggagttggtacttccgtaacgttttcgacaaggtaacttaggtaaacgtttagtaggggttaaggaaaaaacgttaaaggcggttaaccggcccgggtacgttacgttagggtaagggaaagggggtaaacttacgtttacccgaacccggttcctaacgggaaagggtatacgggaaccctaccgaaacgtggttcgtacggacccttaaatttaaccggaaagttcgacgacctaaccgaggaccgacccganacacgacgtcgtactaagtacgngaccgccgaggccngttcccggttagggaaccgtgaattcgnttagtttgaagtttaacgggg

SEQ ID NO: 400066 - DNA, 755 bp, Homo sapiens
  misc_feature: GZ8MTXP01CAIVR.44.56.F01.1.454.CMB.2.raw
  modified_base (454)..(454): a, c, t, g, unknown or other
  modified_base (467)..(467): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagttggctaatcttgtattttccttgttagttttttagaaggtgtccagtgcggaggggcgacgtgggcgggagggtcgggggggggcttgggcacgaggccgaggggcggtctcgtgagctctcctgtgtagtctcgaggtattcagttcttagtgattatctacgttggcctggggtcccgtcgagggcctccggagggggacgggggtcttggaggtggattcgtacgtttcgacaagtaataggtaaaccgttgtgggtagaaagtaaagagtacgcgtgtctaggtaggaagggagtattccgaccgttntacggaaggggtntacggaccttacccgaagtggttcgttacggacccttaagttttaaaccaaagttcggggaaacgtacccgtaaacccgttacggaaaccggaaaccccccggaagaacccgaacggtacgggtcccgtttaccttaacgtttaacccgcgggccggttaccccggaaagggggttcccgtaaacgtttcccccggggaggggggttaaccccttgggtaacgtttgggtaaccctttaggttttaccgggttaaggttttaacgggggttttccggggggaacccgg

SEQ ID NO: 400067 - DNA, 702 bp, Homo sapiens
  misc_feature: GZ8MTXP01DLK7N.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttcttgttagtttttagaggtgtcagtgcgagggcgacgtgggcgggagggtcggggggggcttgggcacgagccgaggggcgtctcgtgagctctcctgtgtagtctcaggtattcagtcttagtgtattatctacgttcggccgttgggtccgtcgaggccgttccggaagggggtaagggggtcgttaggacggttggacttcgttaccgtttcgacgaaggtaaagttaggtaaaacgtttagtgggtaaggtaaaaacgtaaaggcggttaaccgcccgggtacgttacgtagggtaagggaaagggggtaatacgttccgaaccggttcacggaaagggtattacggacttaccgaaacgtggttacgttacggaccttaagtttaaacgaaagtcggaacgtacctaaccgtagacgaccccgaaagccacgaggtcctacgtaacttacgcggccttacggacgggtcgttaccgttcggttaggggtaaccctggtaatcggtacttagtttgggttaagttttaacgggg

SEQ ID NO: 400068 - DNA, 678 bp, Homo sapiens
  misc_feature: GZ8MTXP01D5D26.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagttggctaatcttgtattttccttgttagttttttagaaggtgtcagtgcggagggcgacgtgggcggagggtcgggggggggcttggcacgagccgaggggcggtctcgtgagactctccgtgtgtagtctcgaggtatcagtcttagtgtattatctacgttggccgtgggtccgtcgagggtcctccggagggggaggggtcttggaggtggtattctacgtttcgtacaagaagtaggtaaacgttagtaggtaaggaagtaaaggaacgtacgccggtgtcgtaggtaggaagggtagtacttcaccgtacacgaaggggtactacgaacgtaccgaaacgtgttaggttacggaccttaagtttaaacaagttacggggaacgtaccgaaaccgtaggaaccggaaccccgacgaaccgaacggacggtaccgtacgttacttaccggtcgccgaccgaacgggttcgtaacgtccggttcgggttcgttacgtgtcgtcgttagttagttagttcggtttcggggaaccgg

SEQ ID NO: 400069 - DNA, 832 bp, Homo sapiens
  misc_feature: GZ8MTXP01BKWF1.44.56.F01.1.454.CMB.2.raw
  modified_base (456)..(456): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggtagtttggctaatcttgtattttccttgttagttttttagaaggtgtccagtgcggaggggcgacgtgggcgggagggtcggggggggggtcttgggcacgacgtccgaggggcggtctctgagactctcctggtgtagtctcaggattcagtcttagtgtattatctacgttggcccgttggggtccccgtcgacgggcctacccgggaggggggaacgggggtctttgggacgtggtattccgtaacttttcggacaaggtaaacttaggtaaaacggtttgtaggggtaagggaaaaaacgttaaagggngtacccggccggtacgtacgtaggtaagggaaaggggtaactacgtttaccgaaacccggttcgtaaccggtaaagggggtactaacggaacccttacccgaaaaccggttggttacggtttacgggaaccccttaaattttaaaccggaaaagttccggggaaagaaccccgttaaaaccgtcgggaaaccccgggaacccccgaaaccgggaacccttaacgggaccggggtacccggtttcttaaaacgtttacccggttccgggccccggacccggaaacgggggtcccgttaaccggttcccgggttacggggggaacccttacgggaattcgggacccttagtttttaacggaaggtttttaaccggggg

SEQ ID NO: 400070 - DNA, 703 bp, Homo sapiens
  misc_feature: GZ8MTXP01CO2PE.44.56.F01.1.454.CMB.2.raw
  modified_base (494)..(494): a, c, t, g, unknown or other
  modified_base (506)..(506): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttcttgttagtttttagaggtgtcagtgcggagggcgacgtggcggagggtcgggggggggctggcacgagccgagggcggtctcgtgagactctctgtgtagtctcgaggtattcagtcttagtgtattatctacgttcggccgttgggtcccgtcgacggtccgtccggaagggggaacggggtcttaggtacggttggaacttccgttaacgtttcgtacaagtaacgtaggtaaaagtttgtaggggtaaggtaaaaaaggtaacgtaacgtaccggtccgggtacgtcgtagggtaggaaaggggtaaacttacgtcgacggttacnggaaaacgggtntacgaccttaccgaaagtgttacgtcggaccttaaatttacgaaagtcggaactaccgaaaccgtcggaaccgaacccgtaaccgacgaacgacggttcctacttaactacgttcggccgttacggaggtccgttacgttcccgggttagggaacgtaccgaagttcgacgtttagtttcggttaacgtttcggggg

SEQ ID NO: 400071 - DNA, 694 bp, Homo sapiens
  misc_feature: GZ8MTXP01E00QU.44.56.F01.1.454.CMB.2.raw
  modified_base (289)..(289): a, c, t, g, unknown or other
  modified_base (484)..(484): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtatttttccttgttagttttttagaaggtgtccagtgcgaggggcgacgtggcggaggtcgggggggcttggcacagccgagggcggtctcgtgagctctcctgtgtagtctcaggattcagtcttagngtattatctacgttggccttggggtcccgtcgaggccgtcccgaagggggtaaggggtcttaggagttggacttccgtacttttcgacgagtaaacttaggtaaaacgttagtggggtacggtaaaaagtaaaggtaacgttaccggccgtacggttctagggtagggaaaggggatacttaccgaacccggttntacgaaaggggtatacggacctaccgaacgtaggttcgttcggaacctaatttaaacgaaagttcggaacgccaaaccgtgaacccgacccgaaacgaccacgtacgggtccttattaacttaccgttcggcccgaccgaacgggtccgacgttccccggttaggggaaccgttcgaagtcggaccttagttttgaacgttttaacgggg

SEQ ID NO: 400072 - DNA, 787 bp, Homo sapiens
  misc_feature: GZ8MTXP01BIWSH.44.56.F01.1.454.CMB.2.raw
  modified_base (265)..(265): a, c, t, g, unknown or other
  modified_base (485)..(485): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttcttgttagttttttagaggtgtcagtgcggagggcgacgtgggcggagggtcggggggggcttggcacgagccgagggcgtctcgtgagctctctgtgtatctnaggtattcgagttcttaggtgtattactcgtacgttcggccgttcggggtccctcggacggtccgtaccggagggggaacggggtcgttaggagggttggtacttcgttaaccgtttcgtacgaagtaaacgtaggtaaaaccgttggtagggtagaaagtaaagtaacgtacgcgtcgtacgtagggtagaaagggtaactagttacccgtaccgttanacggaaagggtactacgtaaccttacccgaaagttggtacggttaccggaaaccttaaatttaaacgaaagttacggggaaacgtacccgtaaaaccgttaccgggaaaccggacccccggtaaaccggaaccaaaccggtacggggttacccttacgttaaacgtttaaccgcgggacccgacccgggtaaaggttccggtaaaccgtccccgggttaggggaaccgtttccggaagttccggtaacttttacgggtttaggttaacccgggtttaaggggttttcccggggaaaccgggg

SEQ ID NO: 400073 - DNA, 900 bp, Homo sapiens
  misc_feature: GZ8MTXP01ES66W.44.56.F01.1.454.CMB.2.raw
  modified_base (293)..(293): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttgggctaatcttgtattttccttgttagttttttagaggtgtccagtgcggaggggcgacgtgggcgggagggtcgggggggggggcttgggccacgacggccgaggggccggtctcgtgacgactctcctggtgtagtctcgaggnttcagtcttagtgtattatctacgttcggccgttcggggtccgtcgaggccgttccgggaagggggtaaggggtcctttgggacggttagggtacttacgttaaccgttttccggtactaaggtaaagttacggtaaaaacggttttggtaaggggtaaaggggtaaaaaaaaagggttaaaagtaacggggttaaacccggtccccggggtaacggtttaccgttaacgggggttagggaaaacggggggttaaaacgttacccgttttacccgaacccccggtttaaggttacccggaaaaggggggttaacttaccgggtaaccttaacccgtaaaccgtaaggggttcggttttacggaaaccccgtttaattttaaaccggggaaaagtttcggggaaactaacccgtaaacccgtacggtaaacccgacccccggggtaaaacgtccgtaaaccgggacgggttacccttaaccggttaactttaccggttcgggacccggttaccccgaaggggtcccgttaaccggttcccggaggggggtaacccttacgggtgttacggtccgttaacgttttcgggttaagggttttaaccggggg

SEQ ID NO: 400074 - DNA, 556 bp, Homo sapiens
  misc_feature: GZ8MTXP02GN3EH.44.56.F01.1.454.CMB.2.raw
  modified_base (369)..(369): a, c, t, g, unknown or other
  modified_base (386)..(386): a, c, t, g, unknown or other
  modified_base (411)..(411): a, c, t, g, unknown or other
  modified_base (421)..(421): a, c, t, g, unknown or other
  modified_base (430)..(430): a, c, t, g, unknown or other
  modified_base (441)..(441): a, c, t, g, unknown or other
  modified_base (498)..(498): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgactggcggaggtcgggggggggcttgggcacgagccgagggcggtctctgagactctcctgtgtagtctcaggattcagtcttagtgattatcacttggcctgggtccgtcaggcctccgaggggaggggtcttggagtggatcactttcgcagaatgaaacgttntggtaggaaagtaaagngtacgccgcgtctgtggaaaggganattcaccgtnacgaagggntgacctcaagngtgtgactattacaatgagcaacctgacgacccgagacacgagcgtactattaccgngccgacgaggcctacgtccggtagggaaccgtgacgtcgattagtttaggactttagg

SEQ ID NO: 400075 - DNA, 771 bp, Homo sapiens
  misc_feature: GZ8MTXP02GOLJ6.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagtttttagaaggtgtccagtgcgagggcgactggcggaggtcgggggggggcttgggcacgagccgagggcggtctctgagactctcctgtgtagtctcaggattcagtcttagtgattatcacttggcccgtgggtccgtcgacggtcctaccggaggggaaggggtcttggaggtggattccgtacgtttcgtacgaagtaacgtaggtaaaaccgtttagtaggggtaaggtaaaaggttaaaaggtacgggttaaccggccggtaccggttacgttaggggtaggggaaaagggggtaaattaacgtttcccgaaacccggttcgtaacggaaagggggtatacggaaccctacccgtaaaagtagggttcggtttacggaccctttaaagttttaaaccaaaagtttagggaacgtaccctaaaacccgttagggaaacccggaacccccggaacggaaaccacggaacggggtaccgttacctttaaaacgttaccgttacggcccggacccgaagggtccggtaacgttccccgggttagggggaaccgttacggaagttcggactttaaggttttcggaaattttcggggg

SEQ ID NO: 400076 - DNA, 524 bp, Homo sapiens
  misc_feature: GZ8MTXP02JOP5Q.44.56.F01.1.454.CMB.2.raw
  modified_base (376)..(376): a, c, t, g, unknown or other
  modified_base (482)..(482): a, c, t, g, unknown or other
  modified_base (497)..(497): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcggggggggcttaggcacagccaggggcggtctctgagactctcctgtgtagtctcaggattcagtcttagtgattatcacttggcctgggtcctcaggctccgagggagggcttgagtggatcactttcgcagaatgaaacgttatggtagaagtaaagnggtacgcgcgtctgtagaagggagattcacgtctacaagggatgactcaacagtgtgccatttacaaatgagcaacctgacgacccgagacacgaggctctatacngcgccaggcactccngggaactcgatcgctatttgatttagg

SEQ ID NO: 400077 - DNA, 554 bp, Homo sapiens
  misc_feature: GZ8MTXP02HQ1RO.44.56.F01.1.454.CMB.2.raw
  modified_base (351)..(351): a, c, t, g, unknown or other
  modified_base (371)..(371): a, c, t, g, unknown or other
  modified_base (380)..(380): a, c, t, g, unknown or other
  modified_base (388)..(388): a, c, t, g, unknown or other
  modified_base (405)..(405): a, c, t, g, unknown or other
  modified_base (425)..(425): a, c, t, g, unknown or other
  modified_base (441)..(441): a, c, t, g, unknown or other
tcagacagtatatacacgaccggtgctcgatttagcagacgtctgaacacacaaagggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatataaccttgtctcttggtaccaagtactacccaaggtaaaccccccaaactccttacttatgaagtcaaataacgcggaccctcggcatttctcatcgcttcncagcctcaagtctggcaacncggctcgtnattattcngcctctgctgacgacgngccgtatattattgctgctnatatggtcggtctagnttagttgggtcttcgggcggaggggacccggctcggaccgtccgttaggccaacggcccaacggccctccggccccctggtccacttcctcgtttcccccacccttccttacc

SEQ ID NO: 400078 - DNA, 580 bp, Homo sapiens
  misc_feature: GZ8MTXP02HHATH.44.56.F01.1.454.CMB.2.raw
  modified_base (398)..(398): a, c, t, g, unknown or other
  modified_base (443)..(443): a, c, t, g, unknown or other
  modified_base (530)..(530): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgactgggcggaggtcgggggggggcttgggcacaggcccgaggggcggtctcgtgagactctcctgtgtagtctcaggattcagttcttagtgattatcacttggcctgggtcccgtcgaggctccgaggggaaggggtcttggagtggatctacgttttcgcagtaatagaaacgttatggtaggaaagtaaagngtacgcgcgtctgtaggaaagggagattcaccgtctacgaagggntagacctcaaacgtgtgttcggacctaatttaacaaattgaacgacaaaccgtgaacgacccgaacgacacgaggcgtactaattcngccgccgaggcactccgtgggaaccgtcgagtcgctagtttgatttacgg

SEQ ID NO: 400079 - DNA, 624 bp, Homo sapiens
  misc_feature: GZ8MTXP02HC1AZ.44.56.F01.1.454.CMB.2.raw
  modified_base (315)..(315): a, c, t, g, unknown or other
  modified_base (386)..(386): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactgggcggaggtcggggggggcttgggcacgagccgaggggcggtctctgagactctcctgtgtagtctcaggattcagtcttagtgattatcacttggcctgggtccgtnaggctccgagggagggcttgagtggatcactttcgcagaactagaaacgttatgggtaggaaagtaaacgngtaaccgcgtacgtctggtaggaaaggggaagtattcgacccgtctacgaaaggggatgacctaccaaacgaggttgttacggaccctaagttttaacaaaagttgaacgtaccaaacccgtgacggaaccccgagacacgacgggcgttactaacgttacgtgaccggaccacgggtaccgacttcccggtagggggaaccgtcgaagtcgtacgtaagttttcgaacgtttagggg

SEQ ID NO: 400080 - DNA, 580 bp, Homo sapiens
  misc_feature: GZ8MTXP02H4RO4.44.56.F01.1.454.CMB.2.raw
  modified_base (312)..(312): a, c, t, g, unknown or other
  modified_base (363)..(363): a, c, t, g, unknown or other
  modified_base (408)..(408): a, c, t, g, unknown or other
  modified_base (432)..(432): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtggcgggaggtcggggggggcttgggcacgagccgagggcggtctctgagactctcctgtgtagtctcaggattcagtcttagtgattatcacttggcctgggtccgtnaggctccgagggagggcttggagtggatcactttcgcagaatgaaacgttntggtagaagtaagagtacgcgcgtctgtgaaggagattcaccgtntacgaagggatgactaccgaacgngttgtgctatttacaaatgagacaacctgacgacccgagacacgaggcgtactaattaccgtggcccgaccgacgggccgaacgttcccgtacggggaaccgttcgaagttcggacttagtttgaacgtttaggtttacggggaccgg

SEQ ID NO: 400081 - DNA, 725 bp, Homo sapiens
  misc_feature: GZ8MTXP02IMABG.44.56.F01.1.454.CMB.2.raw
  modified_base (280)..(280): a, c, t, g, unknown or other
  modified_base (419)..(419): a, c, t, g, unknown or other
  modified_base (632)..(632): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgactgggcggagggtcggggggggcttgggcacgagccgagggcggtctcgtgagactctcctgtgtagtctcaggtntcagttcttagtgtattatctacgttggccgtggggtcccgtcgagggcctaccggaggggaaggggtcttggagtggatcgtacgtttcgtacaagtaatagtaaaacgttagtaggggtaaggaaaagttaaaaggnggttaaccgcccggtacggttcgtagggtagggaaaaggggtaactattccgaacccggttctacggaaaggggtatacgactacccgaaagtacggttgttacggacccttaaagttttaaaccaaaagttcggaacacccgaaaaccgttggaaacccggacccccggaaacgaccgaaccgagggtacccttaacttaacgttacccggnggacccgaccggacgggtccgtaaccgttccccggtagggggtaacccttcggaacgtttcggactttacgttttaggtaacgttttcggggg

SEQ ID NO: 400082 - DNA, 567 bp, Homo sapiens
  misc_feature: GZ8MTXP02HMKWF.44.56.F01.1.454.CMB.2.raw
  modified_base (366)..(366): a, c, t, g, unknown or other
  modified_base (380)..(380): a, c, t, g, unknown or other
  modified_base (402)..(402): a, c, t, g, unknown or other
  modified_base (413)..(413): a, c, t, g, unknown or other
  modified_base (513)..(513): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcggggggggcttgggcacagccgagggcggtctctgagactctcctgtgtagtctcaggattcagtcttagtgattatcacttggccctgggtccgtcaggctccgaggggaagggcttggagtggatcactttcgcagaatgaaacgttntggtagaagtaagngtacgcgcgtctgtgaaggganattcgaccgtntacgaagggatagacctcaacgtagtgttggaccctattttaacaaagttgagactaaacctgaacgaccccgaagaccacgacggcgtactaattacgngaccgccgaggccgacttcccgagggaaccgtcgatcggactatttgatttagg

SEQ ID NO: 400083 - DNA, 574 bp, Homo sapiens
  misc_feature: GZ8MTXP02F0TUV.44.56.F01.1.454.CMB.2.raw
  modified_base (339)..(339): a, c, t, g, unknown or other
  modified_base (348)..(348): a, c, t, g, unknown or other
  modified_base (377)..(377): a, c, t, g, unknown or other
  modified_base (389)..(389): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtggcggaggtcgggggggggcttgggcacgaggccgagggcggtctctgagactctcctgtgtagtctcaggattcagtcttagtgattatcacttggcctgggtcctgaggctcgagggagggctgagtgntcatttcgnagatgaaacgttgtggtaggaaagtaagngtacgcgtgtcngtaggaagggatattcgaccgtcacgaaggatggacctcaacgtgtgttacgacctaatttaacaaatgacgacaaccgtaggaccgacccgacacgacgaggtccgtactacgttacgcggccgaccgaggccgtacgtcccgtagggggaactcggaatcggattacgtttagatttacgggg

SEQ ID NO: 400084 - DNA, 606 bp, Homo sapiens
  misc_feature: GZ8MTXP02H7Y8U.44.56.F01.1.454.CMB.2.raw
  modified_base (278)..(278): a, c, t, g, unknown or other
  modified_base (375)..(375): a, c, t, g, unknown or other
  modified_base (391)..(391): a, c, t, g, unknown or other
  modified_base (419)..(419): a, c, t, g, unknown or other
  modified_base (451)..(451): a, c, t, g, unknown or other
  modified_base (527)..(527): a, c, t, g, unknown or other
  modified_base (543)..(543): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgactggcggaggtcggggggggcttgggcacgagccgagggcggtctcgtgagactctcctgtgtagtctctaggnttcagtcttagtgtattatcacttggccttgggtcccgtcgaggcctccgaggggagggcttggagtggatctacgtttcgcagaatgtaaacgttnggtaggaaagtaaagngtacgcgcgttcgtagtggaaagggaanacgtttccaacccggttctacggaaaggggtntacgacctaccgaagtgttgtacggaccttaatttaacaaagtgaacgaccaacgtgaaccgacccgagacaacgnggtctactacgtacgngaccgccgaggtcgtacgtccggtaggggaaccgtcgacgtcgacttagtttacggacttggg

SEQ ID NO: 400085 - DNA, 662 bp, Homo sapiens
  misc_feature: GZ8MTXP02HN6UF.44.56.F01.1.454.CMB.2.raw
  modified_base (406)..(406): a, c, t, g, unknown or other
  modified_base (452)..(452): a, c, t, g, unknown or other
  modified_base (482)..(482): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgacgtgggcgggagggtcgggggggggggcttgggcacgaggccgaggggcggtctcgtgagactctcctgtgtagtctcaggattcagtcttagtgattatcacttggcctgggtcccgtgacggctccgaggggaacggggcttggagtggatcgactttcgcagtaactaggaaacgttagtgggtaggaaagttaaaggnggtaccgcgcgttcgtggtaggaaagggtaagacttcgacccgttntacgaaggggtatacggactaccgaaacgngttgttacggaccctaagtttaaaccgaaaagttggaacgaccaaaccgtgaacgaccccgaagacaacgaaggtcgtacctaattacccgtggaccggacccaggggaccgtacgtcccggtagggggaacccgttaccggaattcgggaaccctagttttacggaagttttaacgggg

SEQ ID NO: 400086 - DNA, 572 bp, Homo sapiens
  misc_feature: GZ8MTXP02IWO9M.44.56.F01.1.454.CMB.2.raw
  modified_base (316)..(316): a, c, t, g, unknown or other
  modified_base (369)..(369): a, c, t, g, unknown or other
  modified_base (382)..(382): a, c, t, g, unknown or other
  modified_base (392)..(392): a, c, t, g, unknown or other
  modified_base (419)..(419): a, c, t, g, unknown or other
  modified_base (520)..(520): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggcttgggcacgagcccaggggcggtctctgagactctcctgtgtagtctcaggattcagtcttagtgattatcactttggccctggggtccgtnaggctccgaggggaaggggcttgagtggatcactttcgcagaatgaaacgttnggtgaagttaagnggtacgccgngtctgtaggaagggaatattcaccgtntacgaagggatgactaccaaagtgtagttggacctaatttacaaaagttgacgtacaaacccgtgaacgaccccgagaacacgaagggctactagttaccngcgcgaggcgtacgtccgtagggaacgtcgagtcgactagtttcgatttagg

SEQ ID NO: 400087 - DNA, 557 bp, Homo sapiens
  misc_feature: GZ8MTXP02FZL02.44.56.F01.1.454.CMB.2.raw
  modified_base (313)..(313): a, c, t, g, unknown or other
  modified_base (378)..(378): a, c, t, g, unknown or other
  modified_base (404)..(404): a, c, t, g, unknown or other
  modified_base (418)..(418): a, c, t, g, unknown or other
  modified_base (428)..(428): a, c, t, g, unknown or other
  modified_base (507)..(507): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggcttgggcacagccaggggcggtctctgagactctcctgtgtagtctcaggattcagtcttagtgattatcacttggcctgggtccgtnaggctccaggggagggcttgagtggatcactttgcagaatgaaacgttatggtaggaagtaaagngtacgccgagtctgtagaaagggganattcaacccggttntacgaagggntgacctaccaaatgtgttcgacctatttaacaaatgacgacaaacctgacgacccgacgacacgaggctactattacgngcgaccgaggcactccggtaggggaacgtcgatcgactagtttcgagttg

SEQ ID NO: 400088 - DNA, 643 bp, Homo sapiens
  misc_feature: GZ8MTXP02HG3W3.44.56.F01.1.454.CMB.2.raw
  modified_base (277)..(277): a, c, t, g, unknown or other
  modified_base (575)..(575): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttccttgttagttttttagaaggtgtccagtgcggaggggcgactggcgggaggtcggggggggcttgggcacgagccgagggcggtctcgtgagactctcctgtgtagtctcaggnttcagtcttagtgattatcacgttggcctgggtccccgtcgaggcctaccggaggggaaggggctttaggaggtggattcgtacttttcgacaaggtaaatacggtaaaaccggtttgtagggtaggaaaaggttaaagaggttacggccgtcgtctaggtaggaaaagggggataagtttcgaccgttcacggtaaaggggatacggacctaccgaacgtagttacgttcggacctaagtttaacaaagtgacgtacaacgtgaacgacccgaacgacacgaggctacgtattacgngccgacgacggcgagtcccgtagggaccgttcgaagtcgacgtagttagtagtacggtttgggaccgg

SEQ ID NO: 400089 - DNA, 548 bp, Homo sapiens
  misc_feature: GZ8MTXP02I94DP.44.56.F01.1.454.CMB.2.raw
  modified_base (380)..(380): a, c, t, g, unknown or other
  modified_base (395)..(395): a, c, t, g, unknown or other
  modified_base (405)..(405): a, c, t, g, unknown or other
  modified_base (415)..(415): a, c, t, g, unknown or other
  modified_base (509)..(509): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagttttttagaaggtgtccagtgcgaggggcgactggtggaggtcgggggggggcttgggcacagccagggcggtctctgagactctcctgtgtagtctcaggattcagtcttagtgattatcattggcctggggtccgtcaggctccgaggggagggcttgagtggatcactttcgcagatgaaacgttatggtagaagtaagagtacgcgngtctgtagaaggganattcaccgtntacgaagggntgactaccaacagtgttggacctatttaacaaatgagacaacctgaacgacccgacgacacgaggcgtactattactcgcgccaggcactccgngggaccgtcgaagtgactagttgattagtttcggggacg

SEQ ID NO: 400090 - DNA, 538 bp, Homo sapiens
  misc_feature: GZ8MTXP02FUIAO.44.56.F01.1.454.CMB.2.raw
  modified_base (380)..(380): a, c, t, g, unknown or other
  modified_base (389)..(389): a, c, t, g, unknown or other
  modified_base (406)..(406): a, c, t, g, unknown or other
  modified_base (417)..(417): a, c, t, g, unknown or other
  modified_base (426)..(426): a, c, t, g, unknown or other
  modified_base (436)..(436): a, c, t, g, unknown or other
  modified_base (494)..(494): a, c, t, g, unknown or other
  modified_base (509)..(509): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcgggggggggcttgggcacagccagggcggtctctgagactctcctgtgtagtctcaggattcagtcttagtgattatcacttggcctgggtccgtcaggctccgagggaagggcttgagtggatcactttcgtcagaatgaaacgttatggtaggaagtaaagngtacgccgngtctgtagaaagggganattcgaccgtntcgaagggntgactcaacngtgtgcctatttacaaatgagacaaacctgaacgcccgacgacacaggcgtctatacngcgccaggcatccgngggaacgtcgatcgctagtttgatttagg

SEQ ID NO: 400091 - DNA, 566 bp, Homo sapiens
  misc_feature: GZ8MTXP02ISWWC.44.56.F01.1.454.CMB.2.raw
  modified_base (353)..(353): a, c, t, g, unknown or other
  modified_base (384)..(384): a, c, t, g, unknown or other
  modified_base (411)..(411): a, c, t, g, unknown or other
  modified_base (421)..(421): a, c, t, g, unknown or other
  modified_base (431)..(431): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcggaggtcggggggggcttgggcacagccaggggcggtctctgagactctcctgtgtagtctcaggattcagtcttagtgattatcacttggcctgggtccgtcaggctccgaggggaggggcttggagtggatctacgtttcgnagtaatgaaacgttatggtagaaagtaaagnggtacgccgcgtctgtagaaagggganattcaccgtntacgaagggntgacctcaacagtgtgacctatttacaatgacgacaacctgacgaccgacgaacacgaaggcgtactactacgtgccgaccgaggccgacttcccgtaggggaacctcggatcgactacgtttggaactttaggg

SEQ ID NO: 400092 - DNA, 543 bp, Homo sapiens
  misc_feature: GZ8MTXP02JHJSV.44.56.F01.1.454.CMB.2.raw
  modified_base (286)..(286): a, c, t, g, unknown or other
  modified_base (368)..(368): a, c, t, g, unknown or other
  modified_base (383)..(383): a, c, t, g, unknown or other
  modified_base (395)..(395): a, c, t, g, unknown or other
  modified_base (406)..(406): a, c, t, g, unknown or other
  modified_base (416)..(416): a, c, t, g, unknown or other
  modified_base (423)..(423): a, c, t, g, unknown or other
  modified_base (497)..(497): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgagggcgactggcggaggtcggggggggcttgggcacgagccagggcggtctctgagactctcctgtgtagtctcaggattcagtcttagngattatcacttggccctgggtccgtcaggctccgaggggaaggggcttggagtggatcacgtttcgtcagaatgaaacgttntggtagaagtaaagngtacgcgcgtcngtagaaggganattcaccgtncaagggntagactccaacagtgttggaccatttacaaatgagcaaacctgacgacccgagacactagggctctattaccgngcgacacggcactccgagggaacgtcgagtcgactagtttgattag

SEQ ID NO: 400093 - DNA, 567 bp, Homo sapiens
  misc_feature: GZ8MTXP02J3VIH.44.56.F01.1.454.CMB.2.raw
  modified_base (292)..(292): a, c, t, g, unknown or other
  modified_base (396)..(396): a, c, t, g, unknown or other
  modified_base (406)..(406): a, c, t, g, unknown or other
  modified_base (422)..(422): a, c, t, g, unknown or other
  modified_base (443)..(443): a, c, t, g, unknown or other
  modified_base (455)..(455): a, c, t, g, unknown or other
  modified_base (477)..(477): a, c, t, g, unknown or other
  modified_base (513)..(513): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgattttccttgtagtttttagaaggtgtccagtgcggagggcgacgtggcggaggtcggggggggcttgggcacgagccgagggcggtctctgagactctcctgtgtagtctcaggattcagtcttagtgattancacttggcctgggtcccgtcgaggcctccgaggggaacggggcttggagtggatctacgtttcgcaagtaactaggtaaacgttagtaggtaggaaagttaagngtaccgccgngtctgtagaaaggganattccaccgtctacgaagggntggacctcaacngtgtcgacctattacaagtgancaacctgacgacccgagacacgaggtctctactacngccgccaggcacgtcccgtaggggaacctcgagtcgactagtttgatttacggg

SEQ ID NO: 400094 - DNA, 606 bp, Homo sapiens
  misc_feature: GZ8MTXP02G74J6.44.56.F01.1.454.CMB.2.raw
  modified_base (534)..(534): a, c, t, g, unknown or other
  modified_base (551)..(551): a, c, t, g, unknown or other
  modified_base (559)..(559): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcgggagggtcggggggggggcttgggcacgaggcccgaggggcggtctctgagactctcctgtgtagtctcaggattcagtcttagtgattatcacttggcctgggtcctgaggctccgaggggagggcttggagtggatcacgtttcgacagaactagaaacgtttagtgggtaggaaagttaaagcggttacgccggtacgtgtggtaggaaaggggaatattccaacccggttctacgaaggggtactaggaccctaccgaaactaggtgttcgaccctaatttaaacaattgagaccaaactgacgacccgacgaacncgagcgtacctattacngccaccgnggcgactccgtagggaacgttcgatcgactagtttcgaagtttcggg

SEQ ID NO: 400095 - DNA, 620 bp, Homo sapiens
  misc_feature: GZ8MTXP02IQFSD.44.56.F01.1.454.CMB.2.raw
  modified_base (387)..(387): a, c, t, g, unknown or other
  modified_base (401)..(401): a, c, t, g, unknown or other
  modified_base (426)..(426): a, c, t, g, unknown or other
  modified_base (437)..(437): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggttgtccagtgcgaggggcgacgtgggcggagggtcgggggggggcttgggcacgagccgagggcggtctcgtgagactctctgtgtagtctcaggtattcagtcttagtgattatcacgttggccttgggtcccgtcgaggcctccgaaggggaacggggtcttggaggtggatcgactttcgacagaatgaaacgttgnggtagaagtaaagngtacgcgcgtcgtggagaaaggganattcgaccgtntacgaagggtatgacctacgaacagttcgtaggtacctaatttaccgaaagttgaagaccgaaacctagaaccgaacccgacgaacacgacggcgtacgttaacgttaccgtaggccgaccgaggccgaacgtccgttaggggaaccgtcgtaacgtcggactattttcggtacgtttaaggg

SEQ ID NO: 400096 - DNA, 585 bp, Homo sapiens
  misc_feature: GZ8MTXP02I2Q46.44.56.F01.1.454.CMB.2.raw
  modified_base (370)..(370): a, c, t, g, unknown or other
  modified_base (420)..(420): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcggaggggcgactgggcgggagggtcggggggggggcttgggcacaggccaggggcggtctctgagactctcctgtgtagtctcaggattcagtcttagtgattatcacttggcctgggtccatcaggctccgaggggagggcttggagtggatcactttcgcagatgaaacgttntggtaggaagtaagagtacgccgcgtctgtgaagggaagattcaaccgtntacgaaggggatgactccaacagttgtggcctatttacaatgagacaacctgacgacccgagacaacgagggcttactagtttactcgggccaccgacgggaccgtaacttcccggtaagggggtaacccttcggaagttcggacttaacgtttttggtaaacgg

SEQ ID NO: 400097 - DNA, 556 bp, Homo sapiens
  misc_feature: GZ8MTXP02I3C36.44.56.F01.1.454.CMB.2.raw
  modified_base (394)..(394): a, c, t, g, unknown or other
  modified_base (429)..(429): a, c, t, g, unknown or other
  modified_base (438)..(438): a, c, t, g, unknown or other
  modified_base (450)..(450): a, c, t, g, unknown or other
  modified_base (470)..(470): a, c, t, g, unknown or other
  modified_base (478)..(478): a, c, t, g, unknown or other
  modified_base (493)..(493): a, c, t, g, unknown or other
  modified_base (509)..(509): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgattttccttgttagttttttagaaggtgtccagtgcgaggggcgactgggcggagggtcggggggggggcttgggcacgagccgaggggcggtctcgtgagactctcctgtgtagtctcgaggtattcagttcttagtgattatcacgttggcctgggtccgtgaggctccgaggggagggcttggagtggatcgtactttcgcagaactgtaaacgttgtggtagaaagtaagngtacgcgcgtcgtgtagaaagggatatcgaccgtnacgaagggntagactcaacgngtgtgcctatttacaatganacaaccgngacgacccgagaacncgagtcgtctattacngccgcaggcgactcgtagggaactcgatcgctagtttcgatttacgg

SEQ ID NO: 400098 - DNA, 607 bp, Homo sapiens
  misc_feature: GZ8MTXP02FKTB7.44.56.F01.1.454.CMB.2.raw
  modified_base (394)..(394): a, c, t, g, unknown or other
  modified_base (431)..(431): a, c, t, g, unknown or other
  modified_base (455)..(455): a, c, t, g, unknown or other
  modified_base (525)..(525): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactggcgggaggtcggggggggggcttgggcacgaggccgaggggcggtctctgagactctcctgtgtagtctcaggattcagtcttagtgattatcacttggccgtggggtccgtcgaggcctccgaggggaagggcttggagtggatctactttcgcagaactgaaacgttatggtaggaaagtaaagngtacgcgcgtctgtaggaaagggaatattcgaccgtntacgaagggatgacctaccaaagngtgttggacctaatttaacaaagtgagacaaacctgaacgacccgagacacgaggtctactaacgttacnggaccgacccaagggcctaacgttcccggtagggggaaccttcggaagttcggacctttaagtttcggaacgttttaagggg

SEQ ID NO: 400099 - DNA, 721 bp, Homo sapiens
  misc_feature: GZ8MTXP02J1YTB.44.56.F01.1.454.CMB.2.raw
  modified_base (370)..(370): a, c, t, g, unknown or other
  modified_base (387)..(387): a, c, t, g, unknown or other
tcagacagtatatacacgaccggtgctcgatttagcagacgtctgaacacacaaaggggagctctgggagaggagccccagccgtgagattcccaggagttccacttggtgatcagcactgagcacagaccaccaaccatggagtttgggctaatcttgattttccttgtagttttttagaaggtgtccagtgcggagggcgacgtggcggaggtcgggggggggcttgggcacagccgagggcggtctctgagactctcctgtgtagtctcaggattcagtcttagtgattatcacttggccttggggtcctcgaggcctcgaggggaagggcttggagtggatcactttcgcagtaactgaaacgttntgggtagaaagttaagngtaccgccgtacgtcgtagtgtaaagggggaatacgtttaccgacccggttccgttacgaaagggggtatcggaaccttacccgaaaacgtaggttggtttacgggaccccttaaatttaacccgaaatttcgaacggaccctaaaacccgttggaaacccgtaaaccccccggaacggaacccaacccggtaagggggtccccgttaaccttaacggtttaaaccgtcgggacccgtaccccggaaaggggtcccgaaacttcccccggggttaagggggcccgttacggaagtcgggttaacctacggtttttacgggaaattttacggggg

SEQ ID NO: 400100 - DNA, 627 bp, Homo sapiens
  misc_feature: GZ8MTXP02FY2AM.44.56.F01.1.454.CMB.2.raw
  modified_base (395)..(395): a, c, t, g, unknown or other
  modified_base (440)..(440): a, c, t, g, unknown or other
  modified_base (453)..(453): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactgggcgggagggtcggggggggggcttgggcacgaggccgaggggcggtctctgagactctcctgtgtagtctcaggattcagtcttagtgattatctacgttggcctgggtcccgtgaggctccgaggggagggtcttggagtggatcactttgcagaatagaaacgttagtaggtaggaaagtaaagngtacgccggacgtctggtaggaaaggggaatacgttcgaccggtntacgaaaggggtntcggacctccaaagtggttagttcggacccttaaatttaacaaagttgaacgtacaaaccgtgaacgaccccgagaacacgaaggtccctattaactacgtcggccgacgagggccgtaacgtcccggtaggggaaccgtcgaagtcggaccttaagtttgggactttaagggg

SEQ ID NO: 400101 - DNA, 742 bp, Homo sapiens
  misc_feature: GZ8MTXP02HG1PZ.44.56.F01.1.454.CMB.2.raw
  modified_base (451)..(451): a, c, t, g, unknown or other
  modified_base (599)..(599): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttccttgttagtttttagaaggtgtccagtgcggaggggcgacgtgggcgggaggggtcggggggggggcttgggcacgaggccgaggggcggtctcgtgagacctctccgtgtgtagtctcgaggtattcagttcttagtgtattatctacgttcggcccgttggggtcccgtcgagggtccgtaccggaagggggaacggggtcgttaggagggttggattccgtacgttttcggactaaggtaacgttaggtaaacgttagtagggttaaggaaagttaaagggnggtaccggtccgtcggtcgtaggtaggaaaggggtaacacgtttccgaacccgttatacggaaaggggtctacggaacctacccgaaagttagggttcgttacggaccttaaagttttaacgaaaagttcgaacgtaccaaaacccgnggaaacccgacccggaagaaaccgaccgtagggtcctccttaaaagttccgtggacccgtacgaaacgggggtctaaccgttcccggtagggggaacccgttcgaagttccggatttacggttttacggaacgttttaggggg

SEQ ID NO: 400102 - DNA, 638 bp, Homo sapiens
  misc_feature: GZ8MTXP02G3489.44.56.F01.1.454.CMB.2.raw
  modified_base (391)..(391): a, c, t, g, unknown or other
  modified_base (410)..(410): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgactggcggaggtcggggggggcttgggcacgagccgaggggcggtctcgtgagctctcctgtgtagtctcgaggattcagttcttagtgtattatctacgttggcccttgggtcccgtcgacggcctccggaggggaaggggtcttggaggtggattccgtacttttcgcaagtaatagtaaacgttnaggggtagaaaagttaagnggtacgccggtcgtcgtaggtaggaaagggagtattccgaccgttcacgaagggatagacctacgaactaggttgtacggacccttaaagtttaaccaaagtagacgacctaaaccgtgaaccggaccccgaggaacacggacggtacgtacttaactacgtggaccgtaccgaaggtccgactccgtagggggcctcggaatcggtactagtttcgaagtttacggg

SEQ ID NO: 400103 - DNA, 613 bp, Homo sapiens
  misc_feature: GZ8MTXP02ILYC2.44.56.F01.1.454.CMB.2.raw
  modified_base (393)..(393): a, c, t, g, unknown or other
  modified_base (434)..(434): a, c, t, g, unknown or other
  modified_base (557)..(557): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcggagggtcgggggggggcttgggcacgaggcccgaggggcggtctctgagactctcctgtgtagtctcaggtattcagttcttagtgattatcacttggcctgggtcctcgaggctccgagggagggcttgagtggatctactttcgacagaactgaaacgttgtggtaggaaagtaaagngtacgccgcgtcgtggtaggaaagggatattcgacccgttntacgaaaggggtatagaacctaccaaacgtagtgttacggacccttaaattttaaaccgaaaagttcgaacgtacctaaacccgtgaaccgaacccgaacgacacgaggtctactacttacgngccgacgacggcgacgtccgagggaacgtcgattcgacttagtttcgagtttacgg

SEQ ID NO: 400104 - DNA, 751 bp, Homo sapiens
  misc_feature: GZ8MTXP02J0G4J.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcggagggcgacgtggcggaggtcgggggggggcttgggcacagccgagggcggtctctgagactctcctgtgtagtctcaggattcagttcttagtgtattatctacgtttggccttggggtcccgtcgacgggtcctccggaggggaacggggtcttaggaggtggacttcgtacgttttcggctaagtaacgtagtaaacgttgtagggttaggaaagttaaaggagtaccgccgtcgtgtagtagggaaaggggatactttaccgacccggttctacggaaagggggtatcggaacctacccgaaacgtgggttcggttacgggacccttaaagtttaaacccgaaaagttcggaaaccggtaccctaaaacccggttggaaacccggtaacccccggaacggaaccaaccggaacggggtcccgttaactttaacgttaaccgcgggaacccggtcccgaagggggtacccgtaacgtttcccccggggaaggggggtccccttaacgggtagttcgtaaccgtttagtttttaggaacgtttttaacggggg

SEQ ID NO: 400105 - DNA, 548 bp, Homo sapiens
  misc_feature: GZ8MTXP02JGPGX.44.56.F01.1.454.CMB.2.raw
  modified_base (315)..(315): a, c, t, g, unknown or other
  modified_base (368)..(368): a, c, t, g, unknown or other
  modified_base (381)..(381): a, c, t, g, unknown or other
  modified_base (389)..(389): a, c, t, g, unknown or other
  modified_base (404)..(404): a, c, t, g, unknown or other
  modified_base (498)..(498): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactgggcggaggtcggggggggcttgggcacgagccagggcggtctctgagactctcctgtgtagtctcaggattcagtcttagtgattatctacttggccctggggtcctnagtctccgaggggaggggcttggagtggatcactttcgcagaatgaaacgttnggtagaagtaagngtacgcgngtctgagaaaggganattcaccgtcacgaagggatgactcaacagtgttggcctatttacaaattgactcaaacctgaacgaccccgagacacgagcgtactattaccnggccgcaacgggcaactccgtaggggctcggatgctagtttgatttacgg

SEQ ID NO: 400106 - DNA, 563 bp, Homo sapiens
  misc_feature: GZ8MTXP02JM1GM.44.56.F01.1.454.CMB.2.raw
  modified_base (395)..(395): a, c, t, g, unknown or other
  modified_base (441)..(441): a, c, t, g, unknown or other
  modified_base (510)..(510): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttgggctaatcttgattttccttgttagttttttagaaggtgtccagtgcgagggcgacgtggcggaggtcggggggggcttgggcacgagccgagggcggtctcgtgagactctcctgtgtagtctcgaggattcagttcttagtgtattatctacttggcccttggggtccctgaggtcctccgaggggagggtcttggagtggatctactttcgacagaatagaaacgttgtggtaggaaagtaagngtacgccgtgtctgtagaaagggatattcgaacggtctacgaaggntcgactcaaactgtgttagacctattaacaatgagcaactgacgacccgagacacgagctactattacngacgccgaggctacgtccgtaggggaactcgatcgactagtttcgatttacgg

SEQ ID NO: 400107 - DNA, 535 bp, Homo sapiens
  misc_feature: GZ8MTXP02JCN2G.44.56.F01.1.454.CMB.2.raw
  modified_base (288)..(288): a, c, t, g, unknown or other
  modified_base (376)..(376): a, c, t, g, unknown or other
  modified_base (384)..(384): a, c, t, g, unknown or other
  modified_base (506)..(506): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgactgggcggaggtcggggggggcttgggcacagccaggggcggtctctgagactctcctgtgtagtctcaggattcagtcttagngattatcacttggcctgggtcctcagtctccgagggaagggcttgagtggatcactttcgcagatgaaacgttatggtagaagtaagngtacgcgngtctgtgaagggagattcacgtctacgaagggatgacctcaacagtgttcggacctatttacaaattgagactaacctgacgacccgacgacacgagcgtctatactgcgcaggcactccgngggaacgtcgatcgactatttgatttagg

SEQ ID NO: 400108 - DNA, 742 bp, Homo sapiens
  misc_feature: GZ8MTXP02IX2L1.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcgggagggtcggggggggggcttgggcacgaggccgagggcggtctcgtgagactctcctgtgtagtctcgaggattcagtcttagtgattatctacgttggccttggggtcccgtcgagggccttcccggagggggaaggggtcctttggaggttgggattcgtaaccgttttcgtacaaggtaaataggtaaaccgtttagtagggtaaggaaagtaaaggacggttaccgccggtcgtcgtaggtagggaaaggggtagacgtttaccgaacccgttctaacggaaaggggtactcggaaacctacccgaaacgtaggttcggttacggtacctaaagttttaaacgaaaagtttggaacgtaccaaaccggttggaaaccgaacccccggaagacctaacgacgggtccttacgttaacgttaccgtcggacccgtaccgacgggaccgtaaccgttcccggaggggtacccgttacgaagttccgaacgttactttggtaacgtttaggggtttccgggggaaacccgg

SEQ ID NO: 400109 - DNA, 723 bp, Homo sapiens
  misc_feature: GZ8MTXP02GMFC6.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggttgtccagtgcggaggggcgacgtgggcggagggtcggggggggcttgggcacgaggccgagggcggtctcgtgagactctcctgtgtagtctcaggtattcagttcttagtgtattatcacgtttggcccgttggggtcccgtcgacggtcctaccggaaggggaacggggtcttaggaggttggattccgtacgtttcgacgaagtaacgtaggtaaacgtttagtggggtaaggtaaagttaaaggcggtaccgccggtcgttcgtagggtaggaaaggggaaatcgttccgaacccgttctaacgggaagggtatacggaacccttacgaaacgtaggttcggttacggacctttaagtttaaaccgaaagttggaacctaccgtaaaccgtcgaaaccgtacccccggaagaaccgacgtacggggtaccttacttaaacgttacgcggccggacccgaggccgtacgttcccgggttaggggaaccgtttcgagttaccgacgtttagtttaggtaaacgttttcggggg

SEQ ID NO: 400110 - DNA, 569 bp, Homo sapiens
  misc_feature: GZ8MTXP02JGE4Q.44.56.F01.1.454.CMB.2.raw
  modified_base (400)..(400): a, c, t, g, unknown or other
  modified_base (439)..(439): a, c, t, g, unknown or other
  modified_base (449)..(449): a, c, t, g, unknown or other
  modified_base (506)..(506): a, c, t, g, unknown or other
  modified_base (522)..(522): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgactgggcggagggtcgggggggggcttgggcacgaggccgaggggcggtctctgagactctcctgtgtagtctcaggattcagtcttagtgtattatcacgttggcctgggtcctcgaggcctccgaggggagggcttggagtggatctactttcgtcagtaactagtaaacgttatagggtaggaaagtaaagnggtacgcggtcgtcgtgtaggaaagggatattcaccgtntacgaagggntagacctcaactagtgttcggacctaatttacaaatgacacaacctgacgacccganacacgagctactatcngacgcaggctactccgagggaactcggatcgactatttgagtttagg

SEQ ID NO: 400111 - DNA, 632 bp, Homo sapiens
  misc_feature: GZ8MTXP02IF817.44.56.F01.1.454.CMB.2.raw
  modified_base (368)..(368): a, c, t, g, unknown or other
  modified_base (386)..(386): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacaggccaggggcggtctctgagactctcctgtgtagtctcaggattcagtcttagtgattatcacttggcctgggtcctcaggctccgaggggagggtcttgagtggatctactttcgcagaatgaaacgtttngggtaggaaagttaaagngtacgcgtcgtctggtaggaaagggaagtattcaccggttctacgaaaggggtatggaacctaccgaaactaggttacgttggaccctaatttttaaaccaaaatttgaagtcaaacccgtgaacgaaccccgaggaaccacgacgggccttactaactttacgtggaccgacccgaaagggcccgaagttccccgagggggtaaccgttcgaagttggaccttagtttttacggaatttaagggg

SEQ ID NO: 400112 - DNA, 628 bp, Homo sapiens
  misc_feature: GZ8MTXP02JB2ZL.44.56.F01.1.454.CMB.2.raw
  modified_base (437)..(437): a, c, t, g, unknown or other
  modified_base (450)..(450): a, c, t, g, unknown or other
  modified_base (472)..(472): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagtttttagaaggtgtccagtgcggaggggcgacgtgggcggagggtcgggggggggcttgggcgacgaggccgaggggcggtctcgtgagctctcctgtgtagtctcgaggattcagttcttagtgtattatctacgttggccgtggggtcccgtcgacggtccgtccggaggggaggggtcgttggaggtggattcgtacgtttcgacgagtaagtagtaaacgttagtagggtaggaaagttaaagcggtacgcgtcgtcngtaggaaaggganacttccgacgtcacgaagggtntagacctacgaaagtgttcgtagacctaatttaacaaagtgaacgaccaacgtgaaccgaccccgagacacgtaggctactacgtacgtgacccgcgagggcctacgttcccggagggtaaccgtacggagtcgacttagtttagacgtttagggg

SEQ ID NO: 400113 - DNA, 734 bp, Homo sapiens
  misc_feature: GZ8MTXP02G98A8.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcggagggtcgggggggggcttgggcacgagccgaggggcggtctctgagactctcctgtgtagtctcaggattcagttcttagtgtattatcacttggcctgggtccgtcgaggctccgaggggagggtcttggagtggatcgtactttcgacagaactagtaaacgttagtagggtaggaaagtaaaggacgtaccggccgtacggtcgtgggtaggaaaggggaaatacgtttccgacccggttctacggaaaggggtcttacggaacctaccgaaacgtaggttacgttacgggacccttaaattttaaaccgaaaagttcggaaagacccgtaaaccgtacggaaaccgaaccccccgaaggaaccaaccggacggggtacccgttacccttaaagtttaacccgtgggaccccgaccccggaagggtacccggtaaccgttcccccgggttagggggaaccccgtttcgggaacgttcggacctttacggtttttacggggaaactttttacggggg

SEQ ID NO: 400114 - DNA, 730 bp, Homo sapiens
  misc_feature: GZ8MTXP02GAGWP.44.56.F01.1.454.CMB.2.raw
tcagacagtatatacacgaccggtgctcgatttagcagacgtctgaacacacaaaggggagctctgggagaggagcccccagccgtgagattcccaggagtttccacttggtgatcagcactgagcacagaccaccaaccatggagtttgggctaatcttgattttccttgttagtttttagaaggtgtccagtgcgaggggcgactgggcggagggtcgggggggggcttgggcacgaggccgaggggcggtctcgtgagactctcctgtgtagtctcaggtattcagttcttagtgattatcacgttggcctgggtccgtcgaggcctccgaggggaggggtcttggaggtggattcgtactttcgactaagaatagtaaaacgttagtagggtaggaaagtaaaggcgtacgccggtcgtcgtaggtaggaaagggaatacttcgacccgtcgtaacgaaaggggattacgaccttacccgaaacgtaggttcggttacggacccttaaattttaaaccgaaaagtttcggaaacgtaccgaaaaccccgttaggaaacccggaacccccggaaacgaaaccgtaaccggaacggggtaccctttacttaaaacgttttacccgcgggaacccgacccggaaacggggtcccgtaacgttccccgggtagggggaacccgttccgaacgttcggacctttaacggttttcggtaaagttttacgggg

SEQ ID NO: 400115 - DNA, 665 bp, Homo sapiens
  misc_feature: GZ8MTXP02GOHGO.44.56.F01.1.454.CMB.2.raw
  modified_base (558)..(558): a, c, t, g, unknown or other
  modified_base (599)..(599): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctcgtggagactctcctgtgtagtctcgaggtattcagttcttagtgtaattatctacgttcgggccgttggggttcccgtcgagggtcctccggaagggggtaacggggtcttggaggttggtacttcgtacgtttcgacgtaagtaattacgtaaaacgttgtagggtaggaaaagtaagaggtaccgcgtcggtcgtggtaggaaagggtaagtattccgaccgtctacgaagggtatacgacctaccgaaacgtgtggttacgacctaagtttaaacaaagttgaacgactaaccgngaccgaacccgagaacacgacggcgttactaacgttaccgnggaccgtccgaagggtccgaactccggtaggggaacctcgaagtcgctaagtttcgagtttacggg

SEQ ID NO: 400116 - DNA, 810 bp, Homo sapiens
  misc_feature: GZ8MTXP02IXPRS.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcgggaggtcgggggggggcttgggcacgagccgaggggcggtctctgagactctcctgtgtagtctcgaggtattcagttcttagtgtattatctacgttggcccgttggggtccctcgaggcctccggaggggaacggggtcgttggaggttgggattccgtaacgttttcgtacgaagtaagtaggtaaaacgtttagtaggggttaggaaaggttaaaaggacgggttaaccggcccggtacggttccgtagggttagggaaaagggggtaaagtacgtttacccgaacccggttcgttaaccggaaaagggggtacttacgggtaaacccttacccgaaaacgttagggtttacggtttacgggacccctttaaagtttttaaaaccgaaaagtttacgggaaacggtacccctaaaacccgttagggaaaccccggaaacccccggaacgggaacccaaaccggacggggtacccgttacgtttaaacgttacccggtcgggacccgtaccggaacgggtccgtaacgttccccggttagggggaacccgtttcggaagttcggaccttacggttttaggaagttttacgggg

SEQ ID NO: 400117 - DNA, 653 bp, Homo sapiens
  misc_feature: GZ8MTXP02I16PT.44.56.F01.1.454.CMB.2.raw
  modified_base (300)..(300): a, c, t, g, unknown or other
  modified_base (319)..(319): a, c, t, g, unknown or other
  modified_base (378)..(378): a, c, t, g, unknown or other
  modified_base (396)..(396): a, c, t, g, unknown or other
  modified_base (410)..(410): a, c, t, g, unknown or other
  modified_base (446)..(446): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggagggcgacgtggcggagggtcggggggggcttgggcacgagccgagggcggtctctgagactctcctgtgtagtctcaggtattcgagtcttagtgaattntcacttggcctgggtcctnaggcctccgaggggagggcttggagtggatcgtactttcgctaagactaggaaacgttntagggtagaaagtaaagngtacgcgcgttacnggtagaaaggggatagtcaccgtactacgaaagggntggacctacgaagtgttgtcgacctaatttaaccaaaagtttggaacgacgtaaacccgttaggaaaccggtacccccgaaaggaaccaaccgtagggggacccttacggtttaaactacggtcgacccggttaccgaacgggggcctaacgtaccggtcggggaacccgttgtaacgtccgagttacgtttggaacctttaggggg

SEQ ID NO: 400118 - DNA, 771 bp, Homo sapiens
  misc_feature: GZ8MTXP02G3KC5.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgagggcgacgtggcggagggtcggggggggcttgggcacgagccgagggcggtctctgagactctcctgtgtagtctcaggtattcagtcttagtgtattatcacgttggccgttgggtcccgtcgaggtcctccggaaggggaaggggtcttagggaggttgggattccgtaacgttttccggacaaggtaaattaggtaaaaccggtttagtaggggtaaggtaaaaggtaaaaggtacgggtaaccgccggtccgttacgttagggtaagggtaaaagggggtaacgtaactttaccgaaacccggttctaaccgggaaaagggggtacttacggaaacccttacccgaaaacgtgggttacggttacgggaaacccttaaattttaaaaccgaaaagttgaaacggacctaaaccccgtgggaaaccgaaacccccggacgaaaccaaccgacggggtacccttacttaaacgtttaccgaggccccgacccgaaaggggcctaacgttccccggtagggggaacctaccggtaacttggacctttagtttacggaacgttttaacgggg

SEQ ID NO: 400119 - DNA, 697 bp, Homo sapiens
  misc_feature: GZ8MTXP02IW6V0.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtggcggaggtcgggggggggcttgggcacgagccgagggcggtctctgagactctcctgtgtagtctcaggattcagtcttagtgtattatcacgttggccgtggggtcccgtcgaggccgtccgaggggaaggggcttggaggtggatcgtacgtttcgtacagtaaatgtaaaaccgttagtgggtaggaaagttaaagacggttaaccgccggtcgtcgtaggtagaaaggggagtacgttccgacccgtctacgaaagggtatacgaacctaccaaacgtaggttacggttacgggaccctaagttttaaaccgaaagttacggaacgtaccgtaaaccgtagggaaaccgaacccccgaacgaacgaacgaacggtccgtacgtaacgttaaccgtcgaccggaccgacggtaccgtacgtcccggtacggggtaccgttacgaacgtcggacgttagtttagtaacgtttaggtttacggggaaccgg

SEQ ID NO: 400120 - DNA, 644 bp, Homo sapiens
  misc_feature: GZ8MTXP02JSML3.44.56.F01.1.454.CMB.2.raw
  modified_base (368)..(368): a, c, t, g, unknown or other
  modified_base (382)..(382): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaggtgtccagtgcgagggcgactggcggaggtcggggggggcttgggcacagccgagggcggtctctgagactctcctgtgtagtctcaggattcagttcttagtgtattatcacttggcccttggggtcctcgaggcctccgaggggagggcttggagtggatctactttcgcagatgaaacgttnggtagaaagtaagngtacgcgcgtcgtgtagaagggaatattccgaaccgtctacggaaaaggggcttacggaacccttaccgaaaacgtggttcgtttacgggacccttaagttttaaaccgaaaagttgaacgtacctaaaaccgtggaaaccgacccccgaaagccaacgacgggtcctacttacttaaccgacgcccgtaagggcccgtaatccccggtagggtaaccgtcgaagttccggacttaagtttcggaatttacggttccggggg

SEQ ID NO: 400121 - DNA, 531 bp, Homo sapiens
  misc_feature: GZ8MTXP02JUF6C.44.56.F01.1.454.CMB.2.raw
  modified_base (192)..(192): a, c, t, g, unknown or other
  modified_base (226)..(226): a, c, t, g, unknown or other
  modified_base (372)..(372): a, c, t, g, unknown or other
  modified_base (408)..(408): a, c, t, g, unknown or other
tcagacagtatatacacgaccggtgctcgatttagcagacgtctgaacacacaaagggggggtcacaagaggcagcgctctcgggacgtctccaccatggcctgggctctgctgctcctcactctcctgactcaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacgcccccaaactcatcatctatgagcctatagacgcctcaggggtttcaactcgcttcactgcctcacgtccgcaccacgcctcctnacaatctctgggctcgagctgagacgagctgtattnttagtgtgctcagatgttcgtcgctatctattagtcgtcgttaggaacggtcgggaaccgtacggtccgtaacccgttcgtaacgggtacaaccggcccgaacggcccctaaaccccagtccg

SEQ ID NO: 400122 - DNA, 605 bp, Homo sapiens
  misc_feature: GZ8MTXP02HFE6S.44.56.F01.1.454.CMB.2.raw
  modified_base (326)..(326): a, c, t, g, unknown or other
  modified_base (464)..(464): a, c, t, g, unknown or other
  modified_base (542)..(542): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcgggagggtcggggggggggcttgggcacgagccgagggcggtctcgtgagactctcctgtgtagtctcaggattcgagtcttagtgattatctacgttggccctgggtcccgtnaggctccgaggggtagggcttggagtggactcgtaacgttttcgactagaactgtaaaacgtttagtgggtaggaaagttaaaggcggttaacgccggcgtacgtgtaggaaagggagtatcgaccgtctacgaaggntagactaccaagagtgtggacctagtttaacaattgacacaaccgtgacgacccgacgacacacgggctactattacngaccgacgacggcgtactcccggtagggccgtacgtatcggtactagtttacgagtttacggg

SEQ ID NO: 400123 - DNA, 696 bp, Homo sapiens
  misc_feature: GZ8MTXP02HKKEU.44.56.F01.1.454.CMB.2.raw
  modified_base (410)..(410): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcggaggtcggggggggcttgggcacgagcccgaggggcggtctcgtgagacctctcctgtgtagtctcaggtattcagttcttagtgtattatcacgttggccgtgggtccgtcgacggcctccggaggggaaggggtcttggaggtggattctacgtttcgcagaacgtagaaacgttgtaggtaggaaagttaaagnggtacgcgtcgtcgtggtagaaagggtagtattcgaccgttctacggaaaggtagtcgaacctaccgaaacgtagttgttacggacccttaagttttaaacaaaagttgaacgaccgtaaaccgtaggaaccgaacccccgaacgaaccgaaccggacggtccgttaaccgttaaacgttaccgtacggacccgtacccggacgggtacccgtaacgttcccggtaggggtaaccgttaccggtacgttacggaccttacgtttacggttaacgttttaacggggg

SEQ ID NO: 400124 - DNA, 790 bp, Homo sapiens
  misc_feature: GZ8MTXP02G3475.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggttgtccagtgcggaggggcgacgtgggcgggaggtcgggggggggcttgggcacgaggccagggcggtctcgtgagactctcctgtgtagtctcgaggattcagtcttagtgtattatctacgttggcctgggtcccgtcgaggcctccgaggggaaggggcttggagtggattcgtactttcgactagaataggtaaaaccgtttagtagggtaggaaagtaaaggacggttaacgccggtacgttcgtaggtaggaaaggggtaagtacgtttacccgaacccggttacgtaccggaaaaggggtacttacgggaaacccttacccgaaaccgtaggtttcggtttacgggaccttaaacgtttttaaaccaaaaggtttcggaaacggtacctaaaacccgttaggggaaacccgaaaccccccggaacggaacccaaacggtaacggggtccctttaacgttaactttaacccggcggacccggtacccggaacggggtaccgtaaccgtttccccgggtagggggaacccgttccgggaaacgttcggaccgtttaaaggtttgggtaaaccgttttaacggggttttcggggggaaccccgg

SEQ ID NO: 400125 - DNA, 657 bp, Homo sapiens
  misc_feature: GZ8MTXP02IHCH3.44.56.F01.1.454.CMB.2.raw
  modified_base (588)..(588): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgacgtggcggagggtcggggggggggcttggcacgagccgaggggcggtctctgagactctcctgtgtagtctcaggtattcagtcttaggtgatttatcacttggcctgggtcccgtgaggctccgaggggagggtcgttgagtggatctactttcgtacagtaatagaacgttatgggtaggaaacgtaagaggtaccgccgtcgtctgggttaagggaaaggggaatacgtttccgaacccggttctaacggaaaagggggattcggaaccttaccgaaacgtaggttggtttaccgaccgttaaattttaaacaaaacttgggaaacgccctaaaaccgtggaaccgaccccgagaaccacgaggtcctaactagttaccgnggaccgtacgaggtccgtacgttccggaggggtaaccgtcgagttcgacttacgtttaggacgtttagg

SEQ ID NO: 400126 - DNA, 536 bp, Homo sapiens
  misc_feature: GZ8MTXP02HRBY3.44.56.F01.1.454.CMB.2.raw
  modified_base (291)..(291): a, c, t, g, unknown or other
  modified_base (317)..(317): a, c, t, g, unknown or other
  modified_base (368)..(368): a, c, t, g, unknown or other
  modified_base (382)..(382): a, c, t, g, unknown or other
  modified_base (397)..(397): a, c, t, g, unknown or other
  modified_base (406)..(406): a, c, t, g, unknown or other
  modified_base (416)..(416): a, c, t, g, unknown or other
  modified_base (460)..(460): a, c, t, g, unknown or other
  modified_base (494)..(494): a, c, t, g, unknown or other
  modified_base (497)..(497): a, c, t, g, unknown or other
  modified_base (510)..(510): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacgagccgagggcggtctctgagactctcctgtgtagtctcaggattcagtcttagngattatcacttggcctgggtcccgtnaggctccgagggagggcttgagtggatcactttcgcagtaatgaaacgttnggtgaaagtaaagngtacgcgacgtctgngaaaggganattcaccgtntacgaagggatgactacaacagtgttgacctatttacaaatgancaactgacacccgagacactaggctctattacgngcncaggcacgtccgngggaactgatcgactattagtagtag

SEQ ID NO: 400127 - DNA, 749 bp, Homo sapiens
  misc_feature: GZ8MTXP02JDTKE.44.56.F01.1.454.CMB.2.raw
  modified_base (509)..(509): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgactgggcgggagggtcggggggggggcttgggcacgaggccgaggggcggtctcgtgagactctcctgtgtagtctcaggattcagttcttagtgatttatctacgttggcccgttggggtcccgtcgagggtcctcccggaggggaaggggtcttaggaggtggattcctacgtttcgtcgtaagaactacggaaaacgtttagtaggggtaggaaaaggttaaaaggaggttaaccggcccggtacggttacctggggtaagggtaaagggggtaaactaagtttcccgaaaccccggttntaccggaaaaggggtactaggaacccttccgaaacgtaggttgttacgggaacccttaattttaaaccgaaagttcggaccggaacccaaaacccgttgggaaacccaccccgggtaaacaaccgacgaaaccggggtcttaacgttaacttaccggcggacccgtaccgacgggaccctacggttccggtacggggtaacgtacggtagtcgtacgttagtttacggtacgtttacggg

SEQ ID NO: 400128 - DNA, 602 bp, Homo sapiens
  misc_feature: GZ8MTXP02H2DHT.44.56.F01.1.454.CMB.2.raw
  modified_base (404)..(404): a, c, t, g, unknown or other
  modified_base (454)..(454): a, c, t, g, unknown or other
  modified_base (534)..(534): a, c, t, g, unknown or other
  modified_base (548)..(548): a, c, t, g, unknown or other
  modified_base (568)..(568): a, c, t, g, unknown or other
  modified_base (581)..(581): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcggaggtcggggggggcttgggcacgagccgagggcggtctcgtgagactctcctgtgtagtctcgaggattcagtcttagtgattatctattcggccgtgggtccgtcgaggctaccgaaggggagggtcttggagtggatactaccttttcgacagtaagtagtaaaacgttgtagggtagaaagtaaagngtaacgcgcgtcgagtagaagggaagtactacgaccgttctacgaagggntagacctacaaacgagtgttacggacctaaagtttaacaaaagtcgaagtaccaaccgtgaaacgacccgagaccaacgngacgtactaatacncgcgtacacggcaccgtcgnggaaccgtgtaancgacttagtttcgagtttcgg

SEQ ID NO: 400129 - DNA, 619 bp, Homo sapiens
  misc_feature: GZ8MTXP02IK072.44.56.F01.1.454.CMB.2.raw
  modified_base (559)..(559): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgattttcttgtagtttttggaggtgtccagtgcgagggcgacgtggcggaggtcgggggggggcttgggcacgagccgagggcggtctctgagactctcctgtgtagtctcaggattcagtcttagtgattatcattggcctgggtcctcaggctccgaggggaggggcttggagtggatctactttcgacagaatagtaaacgttagtgggtaggaaagtaaaggagttaaccgccggtacgttcgtggtagggaaagggtaagtacttcgaacccgttctacggaaagggtactggaccctaccgaaacgtaggttcgttacgggaccttaaagtttaacaaaagttggaacgctaaaaccctgaaccggacccgacgacacgaggcttactaattacncggcgaccgaggcgaactccggtagggaaccgtgactggacttagtttgaacgtttaggg

SEQ ID NO: 400130 - DNA, 725 bp, Homo sapiens
  misc_feature: GZ8MTXP02FV17T.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagttggctaatcttgattttccttgttagttttttagaaggtgtccagtgcgaggggcgactgggcggaggtcgggggggggcttgggcacagccgagggcggtctctgagactctcctgtgtagtctcaggattcagtcttagtgtattatcacttggcctggggtccgtcgaggctccgaggggagggcttgaggtggatctacgtttcgacagtaatggaaaccgttgtaggtaggaaagtaaagagtacgccggtcgtcgtggtagaaggggaagtacttacgaccgtctacgaaagggggtactacggaacctaccaacgtaggttacggttacgggacctaagttttaaacaaaagttcggaaacgtcccgtaaaacccgttgggaaacgaacccccccggaagaaccggaaccgtaacggggtaccttaaccgttaacgtttaaacccggtcgggaccccgacccgaacgggggtaccgtaacggttcccccgggttagggggacccgtttacgggaacgttgggaccctttaaggtttcggtaaaggtttaccgggttttacggggggaaaccccggg

SEQ ID NO: 400131 - DNA, 612 bp, Homo sapiens
  misc_feature: GZ8MTXP02J2GO0.44.56.F01.1.454.CMB.2.raw
  modified_base (416)..(416): a, c, t, g, unknown or other
  modified_base (459)..(459): a, c, t, g, unknown or other
  modified_base (470)..(470): a, c, t, g, unknown or other
  modified_base (515)..(515): a, c, t, g, unknown or other
  modified_base (537)..(537): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggagggcgacgtgggcgggagggtcgggggggggtcttgggcacgaggccgaggggcggtctcgtgagtctctcctgtgtagtctcaggattcagttcttagtgtattatctacgttggcctggggtccctcgaggtcctccggaggggaacgggtcttggagtggatcgtacttttcgacagtaactgtaaaacgttgtagggtagaaagttaaaggngtaccgccggtgtcgtggtaggaaagggatacttccgaccgtntacgaaagggntggacctacgaaagtgttgttcgaccttaagtttacaaatgaacncaaacgtgaacgaccccggaanacgagcgtactactacgtcgcgaccgacgaggcctacgtccggaggtaacgcgagtcgtattagttagagttcgg

SEQ ID NO: 400132 - DNA, 788 bp, Homo sapiens
  misc_feature: GZ8MTXP02GOXPW.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcggagggtcgggggggggcttgggcacgaggccgaggggcggtctctgagactctcctgtgtagtctcgaggtatcagtcttagtgtattatcctacgtttggcccgtttgggtcccgtcgacggcctaccggaaggggaaggggtcttaggaggtggactcgtactttcgacagtaatagtaaacgttgtagggtaggtaaaaggtaaagtacggtaaccgccggtacgttacgtagggtaagggtaaaggggtaaacgtagttacccgaaacccggttgtaaccggaaagggggtactacggacccttaaccgtaaaacggtagtttcggttacgggtaaccctttaaaagttttaaccgaaaaagttcggaaacgtacccgtaaaacccgtagggaaaacccggaaccccccggaaagaaaccccgaaccggacggggttaccttaacccggtttaatttaacccggacggaccccggaccggacggggtacccgaacggtttcccccggtagggggtaaacccttccggaaggtttaccgacgtttacggtttagaaacgtttttacggggg

SEQ ID NO: 400133 - DNA, 636 bp, Homo sapiens
  misc_feature: GZ8MTXP02HTJ1U.44.56.F01.1.454.CMB.2.raw
  modified_base (358)..(358): a, c, t, g, unknown or other
  modified_base (393)..(393): a, c, t, g, unknown or other
  modified_base (432)..(432): a, c, t, g, unknown or other
  modified_base (443)..(443): a, c, t, g, unknown or other
  modified_base (458)..(458): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgaactggcggagtcggggggggcttgggcacagccagggcggtctctgagactctcctgtgtagtctcgaggattcagttcttagtgtattagtctactttggccttgggtccctcgagtctccgaggggagggcttggagtggatcactttcgnagactagtaaacgtgtagggtagaaacgtaaaggngtacgccgcgtcgtagtggaaaggacgattccaccggtntacgaagggtntagacttaccaacgnggttcgttggaccctaagtttaaccaaattgacgacaaacccgtgaccgaccgtacgaacacgtagggacctacttagtaaccgtggaccgaccccgagggggtcccaacgtttcccggggtacggggtaaccgttacgacgttcggtacgtttaacgtttacggtaacgtttagggg

SEQ ID NO: 400134 - DNA, 892 bp, Homo sapiens
  misc_feature: GZ8MTXP02J1W97.44.56.F01.1.454.CMB.2.raw
  modified_base (242)..(242): a, c, t, g, unknown or other
  modified_base (252)..(252): a, c, t, g, unknown or other
  modified_base (285)..(285): a, c, t, g, unknown or other
tcagacagtatatacacgaccggtgctcgatttagcagacgtctgaacacacaaagggggggtcacaagaggcagcgctctcgggacgtctccaccatggcctgggctctgctgctcctcactctcctgactcaggacacagggacctgggcccagtccgcctgactcagccagcctccgtgtctggtctcctggacagtcgctcacctctcctgcactggaactatctgatgttagaaatntaactgtctntgacagtataccagtaaccccaatccttcttangagtcaataagcgccctcggactatttctcatcgtcttctcgacggtcctacctaaagtccgtagggtccaaaaccgaccgggtcccttacggtttacggtaaacttaaactttttccgtcggggttaccccttcccgttcggtaccccgttaggaacccggggtaaaccggaacggggtaccccgtaaaccgtttattttaaacgtttacggtaccgtttacggtcctttaccctaaagtttaacggttacggggtcccgggggttttaaccccgttaaacgggttaaacggttttaagttttaccgggggggttttccgtttttacccgggggggtaccgggggaaaccggggggttaaacccccgggggttaccccggtttccggggttaaaaccccccgggggtttcccgggttaaaaccgggggttcccccgtaaaccggggaacccccggttaaaaccgggggtccccgttaaacccccgggggttaccccccccggttcccgggggtttaacccccttaaaccccgggtttacccccgtttaccccgggtttttacccccccggggtaccccccccgttttccccgtttttaaacccccg

SEQ ID NO: 400135 - DNA, 754 bp, Homo sapiens
  misc_feature: GZ8MTXP02GSGNG.44.56.F01.1.454.CMB.2.raw
  modified_base (447)..(447): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcgggggggggcttgggcacgaggccgaggggcggtctcgtgagactctcctgtgtagtctcgaggattcagttcttagtgtattatctactttcgggccgttggggtcccgttcgacgggtccttacccggagggggaacggggtcttggaggttgggacttcgtacgttttcggtacaaggtaagttagtaaaacggtttagtggggtaaggtaaaggtaaaagnggtaccgccggtacgtcgtaggtagggaaaggggaaagtctttccgaaccggttctacggaaaggggtctacggaccctaaccgaacgtagggttcgttaccgggaccttaaagttttaaaccgaaaagttggaaacgtacccgtaaaacccgtggaaaccggaaaccccccggaaggaacccaacggagggtccttaccttaaaagttcccgtaggacccggtacgacggggtcgtaaccttccccggtagggggaaccgtttaccggagttcgtaccgtttagtttaggtaacgttttacggggg

SEQ ID NO: 400136 - DNA, 719 bp, Homo sapiens
  misc_feature: GZ8MTXP02GXFC7.44.56.F01.1.454.CMB.2.raw
  modified_base (434)..(434): a, c, t, g, unknown or other
  modified_base (446)..(446): a, c, t, g, unknown or other
tcagacagtatatacacgaccggtgctcgatttagcagacgtctgaacacacaaaggggagctctgggagaggagccccagccgtgagattccccaggagtttccacttggtgatcagcactgagcacagaccaccaaccatggagtttgggctaatcttgtattttccttgttagttttttagaaggtgtccagtgcggaggggcgacgtgggcgggagggtcggggggggggtcttgggcacatccgaggggcggtctcgtgagactctcctgtgtagtctcaggtattcagttcttaggtgtattatcctacgttgggccttggggtcccgtcgacgggtcctacccggaagggggaacggggtcttggaggtggacttcctacgtttcgacaagtaagtagtaaacgtttagtgggtaggaaagtaaagnggtaccgccggngttacgtggtaggaaaggggtatacgttccgacccgttcgtacggaaaggggtatggaaccccttaccaaacgtgttcggttacggtacccttaaatttaaacgaaagttcgaaacgtccctaaaccgtcggaaaccggaacccccggaaccggaacaccggtaacgggtccgttaaccttagttacccgtggacccgcccgaagggtaccgaacgtttccgggaggggtaacccgtagacgtcggtacttaggttttaggattttacggggg

SEQ ID NO: 400137 - DNA, 673 bp, Homo sapiens
  misc_feature: GZ8MTXP02FZ92U.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagttgggctaatcttgattttccttgtagttttttagaaggtgtccagtgcgaggggcgactgggcggaggtcggggggggcttgggcacgagccgaggggcggtctcgtgagactctcctgtgtagtctcaggattcagtcttagtgtattactcacgttggccgttggggtccgtcgacggctaccgaggggaaggggtcttggaggtggactcgtacgtttttcgacaagtaaataggtaaaaccgtttagtgggtaggtaaaggtaaagacggtaaccgccggtcgtcgtaggtaggaaaggggaagtattccgaacccgttctacggaaggggtatacggaactaccgaaacgtaggttacgttcggaccttaagtttaaacaaaagttgaacgtactaaccgtggaaaccgaaccccgaagaacctacgacggaccgtattacttaccgtagaccgcgacgggacgacgttccgacggggccgtacgtaagtcgacgttagtttgagttacgggtttacgggaaccgg

SEQ ID NO: 400138 - DNA, 595 bp, Homo sapiens
  misc_feature: GZ8MTXP02GKGBR.44.56.F01.1.454.CMB.2.raw
  modified_base (278)..(278): a, c, t, g, unknown or other
  modified_base (396)..(396): a, c, t, g, unknown or other
  modified_base (446)..(446): a, c, t, g, unknown or other
  modified_base (525)..(525): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggttgtccagtgcggagggcgactggcggaggtcggggggggcttgggcacgagccgagggcggtctctgagactctcctgtgtagtctcaggnttcagtcttagtgtattatctacgttggcctgggtcccgtcgaggcctccgaggggaagggtcttggagtggatctacgtttcgacagaatagaaacgttagtggtagaaagtaaagngtacgccgtgtctagtaggaaagggatattcgaccgttcacgaaaggggntagacctacgaaacgtgtgttgaccttattaacaaatgacacaactgacgacccgagacacgaggtctactagttacgngccgccgaaggccgtaacgtcccggtaggggaaccgttcgattcggacttagtttagacgttttacgggg

SEQ ID NO: 400139 - DNA, 938 bp, Homo sapiens
  misc_feature: GZ8MTXP02GFIZI.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagtttttagaggtgtccaggtgcggaggggcgacgtgggcggagggtcggggggggcttgggcacaggccgaggggcggtctctgagactctcctgtgtagtctcgaggtattcgagtcttagtgtatttactcctacgtttcggcccgttggggttccccgtacgtacggttccctaccggaagggggaacgggggtctttagggaggttgggactttaccgttaacgttttccggtacgaaaggtaaacgttaacgggtaaaaaccgtttaggtaggggttaaggggtaaaaaaggttaaaaagggtacggggttaaacccggaccccggggttacggttaccgttggggttaaacggggaaaagggggtaaacgtacgttttaaacccggacccggttaaccgttaacggaaaagggggtacttacgggaacccttaacccgaaaacggtggttacgggttacgggtaaccctttaaaagtttaaaccgaaaaagtttcgggaaaccgtaaaccgtaaaaccccgttaacggggaacccccggtaaaacccccgggaaaccggtaaaaccgtaacccgggaaacgggggttacccgtttaacctttaaaacgtttaaccccggtccgggtaaccccgggaccccggaaagggggtacccgtaaacccggttcccccggggttaaagggggaacccgtttaaaccggaaggtttcccggtacgtttaaacggtttttacggaaaccggttttttaacgggggg

SEQ ID NO: 400140 - DNA, 767 bp, Homo sapiens
  misc_feature: GZ8MTXP02G5Z4M.44.56.F01.1.454.CMB.2.raw
  modified_base (538)..(538): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttcttgttagttttttagaggtgtccagtgcggagggcgacgtgggcggagggtcggggggggcttgggcgacgagccgagggcggtctcgtgagactctccgtgtgtagtctcaggattcgagtcttagtgtattactctacgttcggcccgttggggtacccgttcgaacgggccttacccggaaggggggtaacggggtctttagggaggttggggtaacttccgtaacgtttttcgacgaagtaaattgggtaaaaacgtttagtaggggtaagggtaaaagttaaaggacgggttaccgaccggtcggttacgtgggttaacgggaaaggggtaagtactttaccgacccggttactacggaaaggggtntacgaacccttccgaaaagtgggttcgtaacggacccttaaagttttaaaccgaaaagtttgaaacggtaccttaaaacccgacggtaaacgacccccggaaacgaccgtaaaccggaggggtacccttacccgttaaaagttcgcggcccgtacgaacgggccgtaaccttccgggtaggggtaaccccgttgtacggtcgtacgttagtttacggtaacgtttcggg

SEQ ID NO: 400141 - DNA, 734 bp, Homo sapiens
  misc_feature: GZ8MTXP02IKZBT.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggcttgggcacgagccgagggcggtctctgagactctcctgtgtagtctcaggattcagtcttagtgattatcacttggcctgggtccgtcgaggcctccgaggggaagggtcttggaggtggatcactttcgtacagtaactagaaaacgtttgtagggtaggtaaagttaaagaggtacgccggtcgttcgtaggtaggaaaggggaagtatttccgaacccggttctacgaaaggggtattacggaaccttaccgaaacgtaggttacggttacgggacccttaaagtttttaaaccaaaagtttcggaaacgtacctaaaaccccgttgggaaaccgaacccccgggaaacggaacccaaccggacgggtccgtttaaccttaagtttaaccgtcggacccgtacccgaacggggtaccgtaccgtttacccgtacgggggtaacccgtttacggacgtttaccggggacctttaacggtttttacggaagtttttaaaccggggg

SEQ ID NO: 400142 - DNA, 786 bp, Homo sapiens
  misc_feature: GZ8MTXP02JXITI.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcggagggtcggggggggcttgggcacgagccgagggcggtctcgtgagactctcctgtgtagtctcgaggtattcgagttcttaggtgtattatctacgtttggcccgttggggtcccgtcgacgggcctcccggagggggaacggggtctttaggaggttgggacttccgtacgtttttccgacgtaagtaaccgtaggtaaaacgtttagtaggggtaaggtaaaaggttaaaggacggtaaccggcccggtcggttacgtagggtagggaaaaggggtaaggtactttacccgaacccggttctacggaaaggggtctacggaaccctacccgaaacgtggtacgtttcgggaacccttaagtttaaacaaaagttggaaacgtaccgtaaaacccgtggaaacccggaacccccgaacgggaaccaaccgggtaacggggaccctttacgtttaacgtttaacccggcggacccggtaccccgaaggggacccggtaacgtttccccggtaggggggaaccttaccggaagttcgggactttacggtttttacgggaaatttttacggggg

SEQ ID NO: 400143 - DNA, 620 bp, Homo sapiens
  misc_feature: GZ8MTXP02JBF4L.44.56.F01.1.454.CMB.2.raw
  modified_base (351)..(351): a, c, t, g, unknown or other
  modified_base (365)..(365): a, c, t, g, unknown or other
  modified_base (415)..(415): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcgggggggggcttgggcacaggccgagggcggtctctgagactctcctgtgtagtctcaggattcagtcttagtgattatctacttggcctgggtcccgcgaggctccgaggggagggcttgagtggatcactttcgnagaatgaaacgttntggtagaagtaagagtacgccgcgtctggtagaagggagattcgaccgtntacgaaaggggtatggaactccaacgtaggttgttcggaccctaagttttaacgaaaattgaacgtaccaaacccttgggaaaccgtaccccgacgaacacgaacgggcgttacattacgtcgccgaccacgggacacgttcccgtaggggaccgttcgaagtcggtacttacgtttgaacgtttacgggtttacgggggaccgg

SEQ ID NO: 400144 - DNA, 682 bp, Homo sapiens
  misc_feature: GZ8MTXP02HF2RQ.44.56.F01.1.454.CMB.2.raw
  modified_base (664)..(664): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggagggtcgggggggggcttgggcacaggccgaggggcggtctctgagactctcctgtgtagtctcaggattcagttcttagtgtattatctacttcggccgtggggtcccgtcgacgggcctcccggaggggaacggggctttggagttgggattcgtacgttttcggtacaagtaaataggaaaaccgtttagtggggtaaggaaacgttaaaaggaggttgccgggtaccgtcgttcgtaggtagggaaagggggaaagtacgttaccgacccgtacgtacgaaaggggtatacgtaaccgtacccaaacgtaggttcggtttacggaacctaaagttttaaccgaaaagtgaaacgtacccaaaccgtacgaaacgacccccggaacgaccgaacgacggtacgtactactttaccgacgccgaccgaggcgtacgtccgagggctcgatcgntattgagttagttcgggg

SEQ ID NO: 400145 - DNA, 570 bp, Homo sapiens
  misc_feature: GZ8MTXP02HX6FS.44.56.F01.1.454.CMB.2.raw
  modified_base (404)..(404): a, c, t, g, unknown or other
  modified_base (412)..(412): a, c, t, g, unknown or other
  modified_base (421)..(421): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgattttccttgtagttttttagaaggtgtccagtgcgaggggcgactggcggaggtcgggggggggcttggcacagcccagggcggtctctgagactctcctgtgtagtctcaggattcagtcttagtgtattatcacttggcctgggtccgtcgaggctccgagggaagggcttgaggtggatctacgttttcgcaagaatgtaaacgttagtggtagaaagtaagagtacgcgcgtctgtgaaggganttcacgtntacgaaggntgactcaacagtgtgctattacaatgagtacactgacgaccgacgacacgagtcgtactagttctacggccgaccgaggcgaaacgttcccgtaggggacccgttgaagttcggtactacgtttagacgtttaggtttcgggggaaccg

SEQ ID NO: 400146 - DNA, 643 bp, Homo sapiens
  misc_feature: GZ8MTXP02GMLF0.44.56.F01.1.454.CMB.2.raw
  modified_base (506)..(506): a, c, t, g, unknown or other
  modified_base (553)..(553): a, c, t, g, unknown or other
  modified_base (582)..(582): a, c, t, g, unknown or other
  modified_base (623)..(623): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaggtgtccagtgcgagggcgacgtgggcgggagggtcgggggggggcttgggcacgaggccgaggggcggtctctgagactctcctgtgtagtctcgaggtattcagttcttagtgtattagtctacgttggaccgttgggtccccgtgaggcctaccggaggggacggggtcttaggaggttggattcctacgtttcgacgtagaacgtagtaaacgtttagtacgggtaggaaacggttaaaaggcggttaaccggaccggtcgttacgtagggtaggaaagggggagttacttccgaaacccgttcgacggaaaggggtntacgaccttacaacgtgtcgtcgactatttaacgaatgacactaacngaaccgcgacacacgtgacttctagtacnggcgccgaaggccgtacgtccgtggggaaccgtgaatcggnttacgttggtaatttcgggg

SEQ ID NO: 400147 - DNA, 749 bp, Homo sapiens
  misc_feature: GZ8MTXP02HVW1C.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcggaggtcggggggggggcttgggcacgaggccgagggcggtctcgtggagacttctccgtgtgtagtctcgaggattcgagtcttagtgtattatctacgttggccgtgggtccgtcgaggcctccgaggggagggtcttaggaggtggtatcgacgttttcgactagtaagtaggtaaacgtttagagggttagggtaaaacgtaaagtacgggtaccgggtaccggtccggttcgtaggtaggggaaaagggtaaggtaacgtttaccgaacccggttctaacggaaaggggtaattacggaacccgttacccgaaaaccgtaggtttacgttacggggtaaccccttaaagtttaaaacctaaagttaggacgtaaacccgtaacccgtagaaccggaacccccggaacgaaaccgaccgaagggtcccgttaacttacgttaaccgtggcccgaccgacggtacgaccgttcccggtaggggtaacccgttggaaccgttgtaccgtaagttttcggtaaacgttttaggggg

SEQ ID NO: 400148 - DNA, 550 bp, Homo sapiens
  misc_feature: GZ8MTXP02FNK1A.44.56.F01.1.454.CMB.2.raw
  modified_base (374)..(374): a, c, t, g, unknown or other
  modified_base (388)..(388): a, c, t, g, unknown or other
  modified_base (506)..(506): a, c, t, g, unknown or other
  modified_base (537)..(537): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgactggcggaggtcggggggggcttgggcacagccgagggcggtctctgagactctcctgtgtagtctcaggattcagtcttagtgtattatcacttggcctgggtccgtcgaggcctccgaggggaacggggtcttgagtggatctacgtttcgtcagatagaaacgttanggtaggaagtaagngtacgcggcgtcgtgtagaaagggatattcgaccgtctacgaagggatgacctcaacgtgtgttgacctattacaaatgaagtcaacgtgacgacccgacacacgagcgtctatacgngccgcaggcacgccgtgggaactcgactcgntatttgatttcgg

SEQ ID NO: 400149 - DNA, 583 bp, Homo sapiens
  misc_feature: GZ8MTXP02H6R55.44.56.F01.1.454.CMB.2.raw
  modified_base (371)..(371): a, c, t, g, unknown or other
  modified_base (388)..(388): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgaggggcgacgtggcggaggtcggggggggcttgggcacagccaggggcggtctctgagactctcctgtgtagtctcaggattcagttcttagtgattatcacttggccctgggtccccgtcgaggctccgagggaggggcttggagtggatcactttcgcagaatgaaacgttanggtaggaaagttaaagngtacgcgcgtctgtagaaggggagattcgacgtctcgaaggatagactccaacagtgttggacctaattttaacaaattagagacaaaccgtgacgacccgaacgacaacgaggcgtacgtacttactcgccgccgaacggcgacgttccgtaggggtaacgtccggagtcgaccgtacgtttgtaatttacggg

SEQ ID NO: 400150 - DNA, 640 bp, Homo sapiens
  misc_feature: GZ8MTXP02FKKH6.44.56.F01.1.454.CMB.2.raw
  modified_base (453)..(453): a, c, t, g, unknown or other
  modified_base (464)..(464): a, c, t, g, unknown or other
tcagacagtatatacacgaccggtgctcgatttagcagacgtctgaacacacaaaggggagctctgggagaggagccccagccgcgagattcccaggagtttccacttggtgatcagcactgagcacagaccaccaaccatggagtttgggctaatcttgtattttccttgttagttttttagaaggtgtccagtgcgagggcgactggcggagggtcggggggggcttgggcacgacggccgaggggcggtctcgtgagactctcctgtgtagtctcaggattcagttcttagtgattagtcacgttggccttggggtccgtcgaggcctccgaggggaggggcttaggagtggatcgtacgtttcgctaagaactagtaaacgttagtgggtaggaaagtaaaggtgtacgccgtcgtctgtagaaagggatattcgaccgtcagaagggntgactccaagngtgtcggacctaagtttacaaagtgagacctaacgtgaacgaccccgagaccacgacgggcttacgtaaagttaccgtggacccgtaccgacgggtaccgtacgttaccccggttagggggaaccccgttacggtaagtccggttccgtaacgttttacggaagttttaacggggg

SEQ ID NO: 400151 - DNA, 707 bp, Homo sapiens
  misc_feature: GZ8MTXP02F6500.44.56.F01.1.454.CMB.2.raw
tcagacagtatatacacgaccggtgctcgatttagcagacgtctgaacacacaaaaggggagctctgggagaggagccccagccgtgagattcccaggagtttccacttggtgatcagcactgagcacagaccaccaaccatggagtttgggctaatcttgtattttccttgttagttttttagaaggttgtccagtgcgaggggcgacgtgggcggagggtcggggggggcttgggcacgaggccgaggggcggtctctgagctctcctgtgtagtctcgaggtattcgagttcttaggtgtaatttatccacgtttcggacccgttggggtcccctacgacgggtccttaccgggaagggggtaacggggtcttagggacggttgggtaacttccgtacgttttcgacgtaagtaacgttagtaaaacgtttagtaggggtaaggaaaagttaaaggcggtaccgccggtagttcgtaggttaacggaaaggggtaatacgttcgaacccgttgacggaaagggtctagaccttaccgaaagtgttcgtacaacttaaagttaacaagtcaacgacctaacgtaggacccgacccgagaaaccgcgaggtctaaccttacgtacgcggcccgtaacgcggtaccgacgttccggtaacggggaactaccgagtaggtactttaggttacggtagtttaaccgggg

SEQ ID NO: 400152 - DNA, 884 bp, Homo sapiens
  misc_feature: GZ8MTXP02HZ3TR.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcgggagggtcgggggggggggcttgggcacgaggccaggggcggtctcgtgagactctcctgtgtagtctcaggtattcagtcttagtgattatctacgttggccttggggtcccgtgacggccttacccggaagggggaacggggtctttagggacggttggggtactaccgtactttttccggactaaggtaaagttacggtaaaaacgttttagtaggggttagggtaaaaaggttaaaacggaggggtaaaccgcccggtacggttaccgttagggggttaagaaaagggggtaaagtacgtttacccgaaacccgggttacttaaccggaaaagggggtactttacggggaaaccccttacccgtaaaaccgtagggtttacggttacggggtaaccccttaaagtttttaaaacccgaaaaagtttcgggaaacggtaacccaaacccggttaggaaccgggtaaacccccggaacggaaacccgacggtaaaccgggggtaccgttactttaaaacgtttccggtaacgggtccccgaaacccggaaacggggtcccgttaaaacgttcccccggggtaggggggtaaaacccggtttcccgggaaaacgtttccccgggggtaactttaaaacgttttttgggggtaaaccgtttttaacggggg

SEQ ID NO: 400153 - DNA, 715 bp, Homo sapiens
  misc_feature: GZ8MTXP02GWDQD.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagttggctaatcttgtattttccttgttagttttttagaaggtgtccagtgcggaggggcgacgtgggcgggagggtcgggggggggcttggcacgaggccgaggggcggtctcgtgagactctcctgtgtagtctcgaggtattcagttcttagtgtattatcctacgttcggtccgttggggtcccgtgacggtccgtcccggaagggggaacggggtcttagggacggttgggtatccgtacgttttcgacgtaagtaaataggtaaaccgttagtagggtaagaaaggtaaagacgtacgccgtcgtcgtaggtaggaaagggtaagtactttaccggaaccgttcacggaaaggggtactacggaaccctaacccaaaggtggttacggttacggacctaaagttttaaacaaagtcgaaacgtaccaaacccgtggaacccgaacccccgagaacacgacggtctactaagtaccgcgccgaccggaggcctaacggttccgacggggaccgttcgaacgttcggacctttaaggttacgtaacggtttacgggttcgggggaaacccgg

SEQ ID NO: 400154 - DNA, 719 bp, Homo sapiens
  misc_feature: GZ8MTXP02HH1IC.44.56.F01.1.454.CMB.2.raw
  modified_base (280)..(280): a, c, t, g, unknown or other
  modified_base (286)..(286): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggagggcgacgtgggcgggagggtcgggggggcttgggcacgaggccgaggggcggtctcgtgacgactctcctgtgtagtcncgaggnttcagttcttaggtgtattatcctacgttggccgttcggggtcccgtacgacggtccgtccggaagggggaacggggtcttggaggttggtactcgttacgttttcgacgaagtaacgttaggtaaaacggtttgtaggggtaaggtaaaaggtaaagggtcggtaccgggtccggtcggttacgagggttacgggaaaggggtactaacgtttccgaaacccggttcgtacggaaagggggtactcggtaacctaaccgtaacgtaggtttcggtacggacctaaatttaaacaacgttgacgtacctaaacgtcgaaaccgacccggacgaacgacggacgggtcctacgttaacgtaccgtggccgtacgacggccgtaacttcccggtaagggcccgtgaacgtgtcttaaggtttcgaagtttcgggg

SEQ ID NO: 400155 - DNA, 694 bp, Homo sapiens
  misc_feature: GZ8MTXP02H0UDZ.44.56.F01.1.454.CMB.2.raw
  modified_base (418)..(418): a, c, t, g, unknown or other
  modified_base (599)..(599): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtgggcgggagggtcggggggggggcttgggcacgaggccgaggggcggtctctgagactctcctgtgtagtctcaggtattcagttcttagtgattatcctattggccgtgggtccgtcgaggctccggaggggaggggtcttaggagttggatctacgttttcgacaagaagttagaaaacgtttagtagggtaggtaaaagtaaacgnggtaaccggccgtacggttcgtagggtaggaaagggggtaatacgttacgacccggttcgtaacggaaagggggtattacgggacctacccgaaacgttagggttcgttaggacccttaaagttttaaaccaaaagttgaacgaccctaaacctcgggaaacgacccccgaacggaaaccncgaaacgggtcttacttaaattcgcggtacccgacgacggcgtacgtcccgtaggggtaacgtcggtatcgagttacgtttgaacgtttacgggg

SEQ ID NO: 400156 - DNA, 806 bp, Homo sapiens
  misc_feature: GZ8MTXP02G15VJ.44.56.F01.1.454.CMB.2.raw
  modified_base (449)..(449): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttccttgttagttttttagaaggtgtccagtgcggaggggcgacgtgggcgggagggtcggggggggggcttgggcacgaggccgaggggcggtctcgtgagactctcctgtgtagtctcgaggtattcagtcttagtgtatttatcacgttggcccgttggggtcccgtcgaggtcctaccgaaggggaacggggtcttggaacggttggaattcctaacgttttccggtactaaggtaaattacggtaaaacgtttagtaggggttaggaaaacgttaaaaggnggtaaccgccgtacggtctagggtaggaaagggggtaaagtacgttaccgtaaacccggttgtaacggaaagggtactacggtaacctaccgtaaacgtacgggttacgttaccggaaacctttaaagtttaaaaccgaaagttcggaaaccgtaacccgtaaaaccgtacggaaacccggaacccccgaaacggaaacgaccggtaacgggtacccgttaaccgttaaacgttaccgttacgggacccggtaaccggtacggggtaccgtaaccggttcccgggtaacgggggtaacccggttacggttaaacgtccggtaacgtttaaggttttacggtaacggttttacggggg

SEQ ID NO: 400157 - DNA, 706 bp, Homo sapiens
  misc_feature: GZ8MTXP02GOZEY.44.56.F01.1.454.CMB.2.raw
  modified_base (354)..(354): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgacgtggcggaggtcggggggggcttgggcacgaggccgaggggcggtctcgtgagactctcctgtgtagtctcaggtattcagttcttagtgtattatctacgttggccttgggtcccgtgacggcctccgaggggagggtctggagtggntctacgtttcgacagaactagtaaacgttagtggtaggaaagttaaggacgtacgccggtcgttcgtggtaggaaaggggaagtacttccgacgtctacgaaaggattacgacctaccgaaagtggttagttagaacccttaattttaaaccgaaagttagaacgtacctaaaaccgtggaaaccgacccccggaaacggaaccaaccggtacgggtacccgtttaaccgttaaaatttacccgtgggaaacccggcccggaaacgggcccgtaaccgttcccggttacggggggaacccttagtaacggtttccgggactttaaacggttttggaacgtttttaacggggg

SEQ ID NO: 400158 - DNA, 811 bp, Homo sapiens
  misc_feature: GZ8MTXP02GYBB5.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggagggcgacgtgggcgggagggtcgggggggggcttgggcacgaggccgaggggcggtctcgtgagactctcctgtgtagtctcgaggattcagtcttagtgtattatctacgttggccgttggggtcccgtcgagggtcctaccggagggggaaggggtctttaggaggttgggaacttccgtaacgttttcgactaagtaacgtaggtaaaacgtttagtaggggtaggaaaagttaaaaggtacggtaccgccggtcgttacgtagggtaagggaaaaggggtaacgtactttacccgaacccggttcgtacggaaaagggggtacttacggaacccttacccgaaaacggttagggttacggtttacggggaaacccctttaaatttttaaaaccgaaaagttcgggaaacggtaaccctaaacccgttaggaaaccggtaaccccccggaacggaaaccaaccgaacggggtacctttacccgttaaatttaaccccggcggaccccgaaccggtaacggggtacccgtaacggtttccccggggacgggggtaaccgttcggtaacgttaccggtactttaacggtttacggtaacggtttacgggg

SEQ ID NO: 400159 - DNA, 678 bp, Homo sapiens
  misc_feature: GZ8MTXP02IWAY6.44.56.F01.1.454.CMB.2.raw
  modified_base (463)..(463): a, c, t, g, unknown or other
  modified_base (580)..(580): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgactgggcggagggtcggggggggcttgggcacgagccgaggggcggtctctgagactctcctgtgtagtctcaggtattcagttcttagtgtattatcacttcggcctgggtcctcaggctccgaggggagggcttggagtggatcactttcgcagaactagaaacgttgtagggtaggaaagttaaaggcgttaccgccggcgttctggtaggaaagggagattcgaccgtctacgaagggatagacctaccgaaanacgttgttacggaccctaaagttttaaccaaaagtttcgaaacgtacccaaaaccgttggaaaccgaacccccggaacgaaccaaccggacgggtccgttacccttaagtttacccnggacccgaccccggagggtacccgtacgttccccggtaggggaacccgttcggaacgttcggaccgtttaacgttttacggtaagtttttaacggggg

SEQ ID NO: 400160 - DNA, 816 bp, Homo sapiens
  misc_feature: GZ8MTXP02GXOCH.44.56.F01.1.454.CMB.2.raw
  modified_base (523)..(523): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgagggcgactggcggaggtcgggggggggcttgggcacgagcccgaggggccggtctcgtgagactctcctgtgtagtctcgaggattcagttcttagtgtatttatctacgttggccttggggtcccgtcgacggcctaccgaagggggtaacggggtctttaggacggttggaacttccgtaactttttcggactaagtaaacgttaggtaaaaccgtttagttaggggttaaggaaaaggttaaaagacgggttaaccgaccggtacgttcgttaggggtacggaaaagggggtaaagtaacgttttccgaaacccccggttntaaccggtaaaagggggtacttacggaaaccccgttaccccaaaagttaccgttggttaaccgggacccttaaagttttaaaccaaaagttccggaacgttaacccaaaccccgtagggaaacccgacccccggaaacgtaaaccgacccggtaaggggtccccgtttaacttaaaacgtttacccggcggcccggaccccgggtaaagggcccgtaacgttccccggttaggggggaaccttaccggaacgttcgggacctttaaacggtttcggtaacttttaaacggggg

SEQ ID NO: 400161 - DNA, 707 bp, Homo sapiens
  misc_feature: GZ8MTXP02GPX7A.44.56.F01.1.454.CMB.2.raw
  modified_base (373)..(373): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttccttgttagttttttagaaggtgtccagtgcggagggcgacgtgggcggagggtcgggggggggctgggcacgaggccgagggcggtctctgagacctctccgtgtgtagtctcaggtattcagttcttagtgtattatcacgttggcccgtgggtccgtcgacggcctaccgaggggagggtcttggaggtggatcgacgttttcgnaagtaagtagaaaacgtttagtaggggtaaggaaaaggttaaagacggttaaccgccgggtcgttacgtagggttacggaaaaggggtaaagtacttacgaacccgtgtaacgaaagggtatacgacctaccgaaacgtagttgttaggacccttaaatttaaaccgaaaagttgaaacgaaccgtaaacccgtaggaaaccgaaccccgaacggaaaccacgaagggtcctaccttaaagtaccgtcggccggtaccgaagggtcccgaacgttcccggaagggggaaccctacggtaagtccggtactaagttttacgaagtttaacggggg

SEQ ID NO: 400162 - DNA, 588 bp, Homo sapiens
  misc_feature: GZ8MTXP02HXKMP.44.56.F01.1.454.CMB.2.raw
  modified_base (360)..(360): a, c, t, g, unknown or other
  modified_base (377)..(377): a, c, t, g, unknown or other
  modified_base (410)..(410): a, c, t, g, unknown or other
  modified_base (434)..(434): a, c, t, g, unknown or other
  modified_base (461)..(461): a, c, t, g, unknown or other
  modified_base (494)..(494): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcactgggcgggaggtcggggggggggcttgggcacgaggccgaggggcggtctctggagactctcctgtgtagtctcaggattcagtcttagtgtaattatcacttgccgtgggtccgtcaggctccgaggggagggacttgagtggatcactttcncagaactgtaaacgttnaggtagaaagtaaagcgtacgcgcgtcgttagnggaaaggaacgattcgaacccgtntacgaaagggattagacctacaaagtntaggttcgacctaaatttaacaaaatcggaaanaccaacgagaccgaccgacacacggacgcttactatacgcgcgacgacgtacgtacgtcggtacggaagtcgactcgtactagttagttagtag

SEQ ID NO: 400163 - DNA, 867 bp, Homo sapiens
  misc_feature: GZ8MTXP02HMTMF.44.56.F01.1.454.CMB.2.raw
  modified_base (287)..(287): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttccttgttagttttttagaggtgtcagtgcggaggggcgacgtgggcgggaggggtcggggggggggcttgggcgacgaggccgaggggcggtctcgtgagactctctgtgtagtctcgaggtntcagttcttagtgtattatctacgttcggccgttggggtcccgtcgacggtccgtaccggaggggaaggggtcgttggaggtggtatcgtacgtttcgagaagtaacgttaggtaaacgtttaggtaggggtaagggtaaaacggttaaaaggtacgggtaaccggtcccggtacggttacgttaggggttaacgggaaaaggggtaaacgttacgtttacccggaaacccggtttactaaccggggaaaaggggtacttaccgggtaacccttaaccccgaaaaaggttcgggttacgggtttaaccggaaacccctttaaaagtttttaaaaccgaaaaaggtttcggaaacgtaaccccgtaaaaccccgttggggaaaaaccccggaccccccggggaaaactacccgaaaccggtaaccggggtaccgtttaaaccccttaaggttttaacccggcgggaccccgtaaccccggaagggtaccccgaaccggtttccccgggttagggggaaccccgtttcgtaagttacccgggtactttaacggttttgggtttaaaccgttttaccgggggg

SEQ ID NO: 400164 - DNA, 607 bp, Homo sapiens
  misc_feature: GZ8MTXP02GBT9G.44.56.F01.1.454.CMB.2.raw
  modified_base (430)..(430): a, c, t, g, unknown or other
  modified_base (478)..(478): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgtagttttttagaaggtgtccagtgcggaggggcgactgggcggaggtcgggggggggcttgggcgacgaggccaggggcggtctctgagactctcctgtgtagtctcaggtattcagtcttagtgattatctattcggccttggggtccgtcgaggcctccgaaggggaacggggtcttaggaggttggaatcgtaacgtttcgtcaagtaatagaaaccgttatgggtagaaagtaagagtacgcgcgtctgtagagggaatntacacgtctacgaaggatgactacacagtgtgactagtttaacaaatnaagacaacgtagaacgaacccgacaacgacgaggcgtactaagttacgcgtccgcgaacggccgtaacgtccgtacggggacgtaccgaagtcgacgtagtttaggtattaacggtttcggggaaccgg

SEQ ID NO: 400165 - DNA, 645 bp, Homo sapiens
  misc_feature: GZ8MTXP02JW3JQ.44.56.F01.1.454.CMB.2.raw
  modified_base (288)..(288): a, c, t, g, unknown or other
  modified_base (294)..(294): a, c, t, g, unknown or other
  modified_base (312)..(312): a, c, t, g, unknown or other
  modified_base (366)..(366): a, c, t, g, unknown or other
  modified_base (416)..(416): a, c, t, g, unknown or other
  modified_base (427)..(427): a, c, t, g, unknown or other
  modified_base (443)..(443): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttccttgttagtttttttagaaggtgtccagtgcgaggggcgactggcggaggtcggggggggcttgggcacgagccgagggcggtctcgtgagactctcctgtgtagtctcaggattcagtcttagngattancacttggcctggtccgtnaggtctcgagggagggcttagagtgatctacttcgtacagaatgaaaccgttgnggtagaagtaagagtacgcgtgtcgtgtacgaagggatacttcgaccgtntacgaagggtntcgacctaccgaaagngttacgttacgggacctaaggtttaaaccaaattcggaagaccctaaacgtcgggaaacccgaacccggaagaacccgacggaaacggtcccgtaactttacgtaacgttcggcccgtacaggggtaccccgattccgggacggtaaccgtcgtaaggtactaccgtttagttaacgacggtttaggttacccgggggaacg

SEQ ID NO: 400166 - DNA, 767 bp, Homo sapiens
  misc_feature: GZ8MTXP02G0NGD.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgagggcggtctcgtgagctctcctgtgtagtctcgaggtattcgagttcttaggtgtattactcctacgttggcccgttggggtcccgtcgacgggcctaccggaagggggaggggtcgttaggacggttggtacttccgtaaccgttttcggactaaggaacgttacggtaaaacgtttagtaggggtaaggtaaaaggttaaaaggacgggtaaccggtcccgggtacgttaccgttagggtaacgggaaaagggggtaaacgtaacgtttacccgaaacccggttcgtaacggaaacggggtattacggaaccctaccgaaacgtaggttcgttacggaccttaagtttaaacaaagttgaacgtacccaaaccgtcgaaccgaacccggacgaaccgacgtacggggaccttaacgttaacgttacgtcggacccgaccgaacgggccgtaccggttccggttaacgggggaaccttacgagttcggactttagttttaggacgttttaacggggg

SEQ ID NO: 400167 - DNA, 699 bp, Homo sapiens
  misc_feature: GZ8MTXP02JOEKL.44.56.F01.1.454.CMB.2.raw
  modified_base (297)..(297): a, c, t, g, unknown or other
  modified_base (611)..(611): a, c, t, g, unknown or other
tcagacagtatatacacgaccggtgctcgatttagcagacgtctgaacacacaaaggggagctctgggagaggagccccagccgtgagattcccaggtagtttccacttggtgatcagcactgagcacagaccaccaaccatggagttggctaatcttgtattttccttgttagttttttagaaggtgtccagtgcggagggcgacgtgggcggagggtcggggggggcttgggcacgagccgagggcggtctcgtgagtactctcctgtgtagtctcgaggtattcagttcttagngtattatctacgttggcccgttggggtcccgtcgacggtccgtaccggaaggggacgggtcttggaggttggacttcctacgttttcgacgagtaaccgtagtaaacgttgagggtaggaaagtaaagcggtaccgcggtcgtacgtggtacggaaagggtatacgttccgaaacccggttcgtacggaaagggtactacgtaacccaccgtaaagtggttcggttaacggacccttaaagtttaaacaaagtcgaaccgtacaaacccgtagaccgacccccgaagacgacgaggtcctacttaacgttccgnggacccggtacgagggtcccgtaacgttccccgggaggggaacccgttacgacgttcggtactttaggtttacgagttttaccggggg

SEQ ID NO: 400168 - DNA, 598 bp, Homo sapiens
  misc_feature: GZ8MTXP02IE9UO.44.56.F01.1.454.CMB.2.raw
  modified_base (481)..(481): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatctgattttccttgttagttttttagaaggtgtccagtgcgaggggcgactggcgggagggtcggggggggggcttgggcacgaggccgaggggcggtctcgtgagactctcctgtgtagtctcaggtattcagttcttagtgtattatctacgttggccgtgggtcccgtcgaggcctccgaggggaggggtcttggagtggatctactttcgcagagtagtaaacgttgtaggtaggtaagtaagagtacgacgtcgtctgtaggaggagattcgaccgtctacgaaggagtgactacagtacgtgtgaccttattaacatgancgaactgacgaccgacgacacgacggactactacttacgtcggctacggacgggtacgcgttacccgaggggtaaccgtacggtactacggtactagttttaggacgtttaacgggg

SEQ ID NO: 400169 - DNA, 721 bp, Homo sapiens
  misc_feature: GZ8MTXP02H0A1W.44.56.F01.1.454.CMB.2.raw
  modified_base (287)..(287): a, c, t, g, unknown or other
  modified_base (488)..(488): a, c, t, g, unknown or other
tcagacagtatatacacgaccggtgctcgatttagcagacgtctgaacacacaaaggggagctctgggagaggagccccagccgtgagattccccaggagtttccacttggtgatcagcactgagcacagaccaccaaccatggagttggctaatcttgtattttccttgttagttttttagaaggtgtccagtgcggaggggcgacgtgggcgggagggtcgggggggggcttgggcgacgaggccgagggcggtctcgtgagactctcctgtgtgtctcgaggtnttcagttcttagtgtattatctacgttcggccgtgggtccgtcgacggtccgtaccggaggggagggtcttaggaggttggactcgtacgttttccgagtaagaagttagtaaaacgtttgtaggggtaaggtaaaggtaaagcggtaccgcggtcgtagtgtaggaaagggatacgtaccgaccgtgtacggaaagggtntacggaaccacgtaaacgtggttcgttacggacctttaaacgtttaaacaaaggtttagaacgtacccgtaaacgtacggaaacccggaccccgaaacgaaaccgtaccgggacggaccgtttaacttaaacgttacccggtcggacccgtaccggaaaggtccgtaaccgtcccgggtacggggaaccgttccggtaagttcggactttaggtttcggtaacgtttacgggg

SEQ ID NO: 400170 - DNA, 735 bp, Homo sapiens
  misc_feature: GZ8MTXP02FZRCK.44.56.F01.1.454.CMB.2.raw
  modified_base (695)..(695): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactgggcggaggtcggggggggggcttgggcacgaggccaggggcggtctctgagactctcctgtgtagtctcaggtattcagttcttagtgatttatctacttcggccgttggggttaccccgtgacggtcctacccggaaggggtaacgggggtctttggaggttgggacttccgtaacgtttcggtacgtagtaaacgttaggtaaaaccgtttagtaggggttaaggaaaaggttaaaagggacgggttaaccggccggtacggttccgtagggttaggggtaaaaggggtaaacggtactttaccggaaccccggttcttacggaaagggggtacttacgggaacctttaccgaaaacgtggttacggttacggacctaagttttaaaccaaaagtttcgaacgtaccgtaaaccgtaggaaccgacccggaaccgaacgacgacgggtctacttatacctgccgtacacggccgaacgtcccggngggtaaccgtcgaagtcgactacgtttagacgtttagggg

SEQ ID NO: 400171 - DNA, 627 bp, Homo sapiens
  misc_feature: GZ8MTXP02GYYFV.44.56.F01.1.454.CMB.2.raw
  modified_base (421)..(421): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttgggctaatcttgtattttcttgttagttttttagaaggtgtccagtgcggaggggcgacgtgggcgggagggtcggggggggggcttgggcacgagccgagggcggtctcgtgagactctctgtgtagtctcgaggattcgagtcttagtgtattatcctacgtttggcccgttgggtcccgtgacggtcctaccggaggggaaggggtcttggaggtggatctacgtttcgtcaagaattagtaaaacgttgtagggtaggaaagttaaaggngtaccgcggtacgtacgtgaggaaagggagtatcgaccgtcacgaggagtagacctacaacgtgtagtgacctatttaacgaattgacacaaccgtgaacgacccgacgaactacgacgtcgtacttacgtactcggcaccggaggccgtactcccggtaggggtaaccgtcggtagtcgaacgtagtttaggtacgtttacgggg

SEQ ID NO: 400172 - DNA, 751 bp, Homo sapiens
  misc_feature: GZ8MTXP02F84OJ.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcggagggtcgggggggggcttgggcacgagccgagggcggtctcgtgagctctcctgtgtagtctcgaggtattcagtcttagtgtattatctacgttcggtccgtgggtcccgtcgacggcctaccggaggggagggtcttggaggtggacttcgtactttcgtacgagtaacgtagtaaacgttagtgggtaaggaaaagttaaaggacggtaccgccggtcggtacgtgggtaaggaaaggggtaaatacgttcccgaaacccggttctaacggaaaggggtacttacggaacccttaaccgaaacggtgttacggtacggtaaccttaaagtttaaaccgaaaagttcggaacgtaaccctaaaaccgtcggaaacccggaccccggaacgaaacctaaccggaggggtaccctttaacttaacgttaaccgtcggaccccgacccgtaaagggggtccctaaaccggttcccggtaacgggggaaccgtttcggaaatttcgaacgtttagtttccggaagttttaacggggg

SEQ ID NO: 400173 - DNA, 717 bp, Homo sapiens
  misc_feature: GZ8MTXP02H7HCQ.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttcttgttagttttttagaaggtgtccagtgcggaggggcgacgtggcgggagggtcgggggggggcttggcacgagccgagggcggtctcgtgagtctctccgtgtgtagtctcgaggtattcgagttcttaggtgtattactcgtacgttggccccgttgggtcccgtcgaggtccgtaccggaggggagggtcttggagtggtatcgtacgtttcgacaagtaactagtaaacgttgtagggtaggaaagtaaagtcgtaccgcgtacgtcgtaggtacggaaagggtagtacttccgaaccgttcgaacggaaagggtactacggacctaccgaaacgtcggttacgtacggtaccttaaagtttaaccgaaagttggaacgaccgtaaaccgtggaaacccggaccccgtaacgactacgggacgggtccttaaccttaaacgttcccggtcggacccgtaccggtaacggggaccgtacgtttcccgggacgggggttaacgtccggtaagttccgtacgtttacggtttaggtacggttttacgggg

SEQ ID NO: 400174 - DNA, 588 bp, Homo sapiens
  misc_feature: GZ8MTXP02IATTQ.44.56.F01.1.454.CMB.2.raw
  modified_base (398)..(398): a, c, t, g, unknown or other
  modified_base (412)..(412): a, c, t, g, unknown or other
  modified_base (420)..(420): a, c, t, g, unknown or other
  modified_base (430)..(430): a, c, t, g, unknown or other
  modified_base (439)..(439): a, c, t, g, unknown or other
  modified_base (449)..(449): a, c, t, g, unknown or other
  modified_base (473)..(473): a, c, t, g, unknown or other
  modified_base (484)..(484): a, c, t, g, unknown or other
  modified_base (489)..(489): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgattttcctgttagttttttagaagtgtccagtgcgagggcgacgtggcggaggtcggggggggcttgggcacgagccgagggcggtctcgtgagactctcctgtgtagtctcgaggattcagtcttagtgtattatcacttggcccttgggtcccgtcgaggcctaccgaggggtaagggtccttggaggttggattcactttcgacaagaatagaaacgttagaggtagaagtaaagngtacgcgcgtctgnggaagganattcacgtcncgaaagggntgactcaagngtgtgctattacaatgagcaacgngaacgacccgngaacncgagggctactaacgtcgtgccgtaccgagggtcctaacggtcccgtagggggaaccgtcggtaaactgggtacctagttttacggtaaactttcgggg

SEQ ID NO: 400175 - DNA, 893 bp, Homo sapiens
  misc_feature: GZ8MTXP02FYZN5.44.56.F01.1.454.CMB.2.raw
tcagacagtatatacacgaccggtgctcgatttagcagacgtctgaacacacaaagggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttggcacgaggccgaggggcggtctcgtgagactctcctgtgtagtctcgaggtattcagtcttagtgtatttatctacgttggccttggggtcccgtcgaggcctccggaaggggaaggggtcttggaggtggatctacgtttcgtcagtaactggtaaaacgttgtagggtaggtaaaagtaaggacgtaccgccggtacggttcgtaggtagggaaaagggggtaatacgtttacccgaacccggtttacgtaaccggtaaaagggggtacttaccgggaacccttaaaccccgaaaacggttggttaacggggtttcgggaccccttaaaagtttttaaaccgaaaaaggttcgggtaaaaccgtaaccccgtaaaaaccccggttaggggaaacccgggtaaacccccccgggtaaaccggtaaaaccggtaaacccccggtaaagggggtaacccccgttttacctttaaaaggttttaaaccccccgggtacggggtaaacccccgggtaaaccccggtaaacggggggtacccgttaaaccggttacccccgggggttaacggggggtaacccggtttaacccgggtaagggttcccggttaaacgtttaacgggtttttaaacggggtaaccggtttttaaaacgggggg

SEQ ID NO: 400176 - DNA, 708 bp, Homo sapiens
  misc_feature: GZ8MTXP02F4MVB.44.56.F01.1.454.CMB.2.raw
  modified_base (391)..(391): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttcttgttagttttttagaaggtgtccagtgcggaggggcgacgtgggcggagggtcgggggggggcttgggcacgaggccgaggggcggtctcgtgagactctcctgtgtagtctcaggattcagtcttagtgatttatcacgttggccttggggtccctcgaggcctccgaggggaggggtcttggaggtggatctacgtttcgacagtaaactgtaaaacgttntaggggtaaggaaagtaaaggagtaaccgccgtcgtacgtggtaagggaaagggtaatactttccgaacccggttctaagaaagggggtattacggaacccttacccgaaaagtggttacggttacggtaacccttaaagttttaaaacaaaaagttcggaaacgtaaccaaaccgtaggaaaccgaaccccgaacgaacgaaccgtagggtaccgtacttaacgtttacgcggaccgacccgaaagggccgtaacgtcccggttgggggaaaccttccgtaagtccggactttaagtttcggaattttaccggggg

SEQ ID NO: 400177 - DNA, 642 bp, Homo sapiens
  misc_feature: GZ8MTXP02FZ6KI.44.56.F01.1.454.CMB.2.raw
  modified_base (458)..(458): a, c, t, g, unknown or other
  modified_base (470)..(470): a, c, t, g, unknown or other
  modified_base (588)..(588): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcgacgaggccgaggggcggtctctgagactctcctgtgtagtctcgaggattcagttcttagtgtattatctacgttggccgtgggtccgtcgacggtcctccgaggggaacgggtcttggaggtggattcgtacgtttcgtacagtaactagtaaacgttagtagggtagaaagtaaagagtacgccgtgtcgtgtaggaaagggatattccgaccgtntacgaaagggtntacgacctaccaaagtggttacgtacgacccttaatttaaacaaaagttgacgtaacccgaaacgtcggaaaccggtaccccgaacgaactaccgacgggtactaccttagttaccgngacccgtacgaggcgtacgtccgtgggaactgactcgctagtttgagtttacgg

SEQ ID NO: 400178 - DNA, 656 bp, Homo sapiens
  misc_feature: GZ8MTXP02I7MLG.44.56.F01.1.454.CMB.2.raw
  modified_base (459)..(459): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcgggggggggcttgggcacgaggccgagggcggtctcgtgagactctcctgtgtagtctcaggattcagtcttagtgattatctacttggcctggggtccctcgaggcctccgaggggaggggtcttggaggtggattcgtactttcgacagtaatagtaaaccgtttagtagggtaggtaaaagtaaagaggtaccgccggtgtcgtaggtaggaaaggggaagtactttccgacccgttntacggaaaggggctaggacctacaactggttgttcggacctaatttaaacaaatgaacgacaacgtgaacgaccccgagacacgaggtcgtatactacgtgaccgtacgacgggcctacgtccccggtaggggaaccgttcgtaagttaccgagttacgtttacggtaagtttacgggggtttaccgggggaaccgg

SEQ ID NO: 400179 - DNA, 618 bp, Homo sapiens
  misc_feature: GZ8MTXP02IUSKS.44.56.F01.1.454.CMB.2.raw
  modified_base (297)..(297): a, c, t, g, unknown or other
  modified_base (394)..(394): a, c, t, g, unknown or other
  modified_base (457)..(457): a, c, t, g, unknown or other
  modified_base (563)..(563): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcgacgtggcggaggtcgggggggggcttgggcacgagccagggcggtctctgagactctcctgtgtagtctcaggtattcagtcttagtgatttancacttggcctgggtccgtcaggctcgaggggagggcttggagtggatcgtactttcgcaggaataggtaaaacgttgtagggtaggaaagttaaagnggttacgccgtacggtctggaggaaaggggaatacttccgaaccggttctacggaaaggggtntaggaccttaccgaaacgtagggtgttacgggaccctaagtttaaacaaaacgttgacgtacaaaccgtgaacgaccccgaagacacgagggctactaacttacgnggccaccgaggccgacgtccgagggtccggacagtcgactagtttgatttacggg

SEQ ID NO: 400180 - DNA, 798 bp, Homo sapiens
  misc_feature: GZ8MTXP02FXIO5.44.56.F01.1.454.CMB.2.raw
  modified_base (411)..(411): a, c, t, g, unknown or other
tcagacagtatatacacgaccggtgctcgatttagcagacgtctgaacacacaaagggggagctctggggagaggagccccagccgtgagattccccaggagtttccacttggtgatcagcactgagcacagaccaccaaccatggagtttgggctaatcttgattttccttgttagttttttagaaggtgtccagtgcgaggggcgactggcggaggtcggggggggtcttgggcacgagccgagggcggtctctgagactctcctgtgtagtctcaggattcagtcttagtgtattatcacgttggcctgggtcccgtgacggctccgaggggaagggtcttggagtggatcactttcgtcagaactagtaaacgttagtgggtaggaaagtaaagcgtaaccggccgngtctaggtaggaaaggggtaagtatttaccgacccgttacgtacggaaaggggtctacggaacccttacccgaaaacgtagggtttcgggtttacgggtaccccttaaagtttttaaaccgaaaaacgtttcgggaaaccgtaccccgaaaaccccgtttggggaaaaccccgggaacccccccggaaacggtaaacccgaaaccggtaacgggggtcccggtttaaccctttaaaacgtttaacccggtgggaccccccggaacccggtaaacgggggtaccccgtaaacggtttacccccgggtagggggggtaaaccccgtttcccggaaaagttcggggtaccctttaaaggtttttaccgggaaagtttttaaaccgggggg

SEQ ID NO: 400181 - DNA, 625 bp, Homo sapiens
  misc_feature: GZ8MTXP02HGY1Y.44.56.F01.1.454.CMB.2.raw
  modified_base (284)..(284): a, c, t, g, unknown or other
  modified_base (297)..(297): a, c, t, g, unknown or other
  modified_base (387)..(387): a, c, t, g, unknown or other
  modified_base (403)..(403): a, c, t, g, unknown or other
  modified_base (429)..(429): a, c, t, g, unknown or other
  modified_base (442)..(442): a, c, t, g, unknown or other
  modified_base (455)..(455): a, c, t, g, unknown or other
  modified_base (566)..(566): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggaggtcggggggggcttgggcacgagcccgaggggcggtctctgagactctcctgtgtagtctcgaggnttcagttcttagngtattatctacttggcccttggggtccctcgaggcctccgaggggaagggcttggagtggatcacgtttcgacagaatagaaacgttagnggtaggaaagtaacgngtaccgcgcgtgtgtagaaagggtanattcgacccgttntacgaaaggggtntggaacctacgaacgtaggttgttacggaccttaaagtttaacaaaagttggaacgtaccaaaccgtggaacgaccccgaacgacacggaacgtcgtaccttaagtcccgnggaccgacgacggccgtactccggtagggaacgtcgagtcgactagtttagacgtttgg

SEQ ID NO: 400182 - DNA, 833 bp, Homo sapiens
  misc_feature: GZ8MTXP02HPK0N.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttccttgttagttttttagaaggtgtcagtgcggaggggcgacgtgggcgggagggtcggggggggggcttgggcacgagccgagggcggtctcgtgagactctcctgtgtagtctcgaggtattcagtcttagtgtattatctacgttggccgtggggtcccgtcgaggtcctaccgagggggaacggggtcttagggaggttagggtatccgtacgtttttccgacgtaagtaaccgttaggtaaaacggtttgtaggggttagggaaaaggttaaaagggtaggtacccgggtaccggtccggttcgttaaggggtaggggaaaaggggtaaacgtacgtttacccgaacccggttaccgttacgggaaaacgggggtattacggtaacccgtaacccgtaaaacggtggtttaggtttaccgggaccctttaaagttttaaaccgtaaaagtttacggaacggtaacccctaaaacccggtggaaaccccgggtaaacccccgggaaacgaaacccgaaacggaccggggttaccttaacccggtttaaactttacccgggccggacccggtacccggaacggggtcccgtaaccggtttccccggtagggggtaaccgttcggaacgtttcgggaactttagttttacgggtacgttttacggggg

SEQ ID NO: 400183 - DNA, 609 bp, Homo sapiens
  misc_feature: GZ8MTXP02FNAOP.44.56.F01.1.454.CMB.2.raw
  modified_base (286)..(286): a, c, t, g, unknown or other
  modified_base (364)..(364): a, c, t, g, unknown or other
  modified_base (378)..(378): a, c, t, g, unknown or other
  modified_base (390)..(390): a, c, t, g, unknown or other
  modified_base (413)..(413): a, c, t, g, unknown or other
tcagacagtatatacacgaccggtgctcgatttagcagacgtctgaacacacaaagggggagctctgggagaggagcgccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcgggggggggcttgggcacgaggccgaggggcggtctcgtgagctctcctgtgtagtctcaggnttcagtcttagtgattatcacttggcctgggtccgtcgaggctccgaggggaggggtcttggagtggatcactttcgnagatgaaacgttgnggtagaagtagngtacgccgtgtctgagaaggganattccgacgtctacgaaggggtatcgactaccgaaagtggtggtttcgacctaagtttaacaaagttgaacggtaccaaaccgtggaaccgacccccggaacgacgaaccgagggcccttactaagttaccgtcggaccgcccgaaaggggccgtacgttcccgaaggggtctaccgagtgacttacgtttgaacg

SEQ ID NO: 400184 - DNA, 631 bp, Homo sapiens
  misc_feature: GZ8MTXP02JXDNB.44.56.F01.1.454.CMB.2.raw
  modified_base (311)..(311): a, c, t, g, unknown or other
  modified_base (604)..(604): a, c, t, g, unknown or other
  modified_base (609)..(609): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggttgtccagtgcgaggggcgactggcggaggtcggggggggcttggcacgagccgagggcggtctcgtgagtactctcctgtgtagtctcaggattcagttcttagtgattatcacttggcctggtcctnaggctcgagggagggcttgagtgatctacttgcagatgaaaccgttgaggtaggaagtaacgagttacgccggtacgtgtacggtagaagggagatttaccgaaaccgttctaacgaaagggggtactcgggtaaacccttcccgaaaagtgggttagtttacggggacccccttaaaaggtttttaaccaaagttccggacgtacgaaacccttgggaaaacgaccccccgagaacccacgaggtccttactataacgtcgcgccagggtcccagtcccgtaggggcctagntacgnttagttgactttacggcgggac

SEQ ID NO: 400185 - DNA, 694 bp, Homo sapiens
  misc_feature: GZ8MTXP02IFL7D.44.56.F01.1.454.CMB.2.raw
  modified_base (278)..(278): a, c, t, g, unknown or other
  modified_base (284)..(284): a, c, t, g, unknown or other
  modified_base (441)..(441): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccacaaccatggagtttggctaatcttgtattttccttgttagttttttagaggtgtccagtgcggagggcgacgtggcgggagggtcggggggggggctgggcgacgaggccgagggcggtctcgtggagactctcctgtgtagtcncaggtnttcgagttcttagtgtattatcacgttggcccgtgggtcctacggacggccgtaccggaagggggaacgggtcgttaggaggtagggtactccgtaccgtttcggtactaaaggtaacgtaggtaaaaccgttgtaggggtaaggtaaaggtaaagnggtaaccgcggtcgtacgtaggtcggaaagtacgagttcgacgtacgtacgaggtactagtaacctacgaacgtagtacgttacgtacgtaaactttaacgtaaagttagaacgtagtaacccccccgtagaaccgaacccggaccgaaccgacggacggaccgtacgttacgttacgtcggacgaccgacggaccgtacgtaccgtacgggaaccggtcgacgtacgtacgtacgttagttacgtttacggg

SEQ ID NO: 400186 - DNA, 606 bp, Homo sapiens
  misc_feature: GZ8MTXP02ITSV8.44.56.F01.1.454.CMB.2.raw
  modified_base (294)..(294): a, c, t, g, unknown or other
  modified_base (374)..(374): a, c, t, g, unknown or other
  modified_base (447)..(447): a, c, t, g, unknown or other
  modified_base (528)..(528): a, c, t, g, unknown or other
  modified_base (548)..(548): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgtattttccttgttagttttttagaaggtgtccagtgcgaggggcacgtgggcgggagggtcgggggggggcttgggcacagccaggggcggtctctgagactctcctgtgtagtctcaggattcagtcttagtgattntcacttggcctggggtccctgaggcctccgaggggaaggggtcttggagtggatctactttcgcagaatgtaaaccgttntgggtagaaagtaaagagtaccgcgtcgtcgtggtagagtggaaagtcttaccgaccgttctacgaaaggggntaggacctaccaaagtggttgttacgacctaatttaacaaagtggaacacctaaccgtagaaccgacccgagacaaccggnggtaccgtactacttaccgngccgcgacggctacgtccggtgggactcgatgactagtttcagtttacggttcggggg

SEQ ID NO: 400187 - DNA, 694 bp, Homo sapiens
  misc_feature: GZ8MTXP02I67DW.44.56.F01.1.454.CMB.2.raw
  modified_base (298)..(299): a, c, t, g, unknown or other
  modified_base (325)..(325): a, c, t, g, unknown or other
tcagacagtatatacacgaccggtgctcgatttagcagacgtctgaacacacaaaggggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctccaccctctcctgcactaggaactatctgtatgtagaaatataaccttgtctctgtacagtactaccacgtaaacccccaactcctcttannaatcaatagcgcctcggctagtttcnatcgtcttctcgacggtcccctacgaacgtcgtacggaccaaccgacggtcccttcgttacgtaagtttaactttcgtcgtccctcccgttgcccttgaccgtacggacggtacccgtatttagtacttcggactcgtcctatacttacggtcgggttaccggttacccgtagtacgttacggtttggggttcccgtacggggcgggtaacgggggtaccccgtcgtcccggtacccggtttacgtaccggggttaccaccgggtaccccggtaaacggggtccccttaccccgggtccccccgttgggttacccgtacccgtttcccgttacccccggtcccccgttcccctttccgtttaaaccccg

SEQ ID NO: 400188 - DNA, 684 bp, Homo sapiens
  misc_feature: GZ8MTXP02JUNIO.44.56.F01.1.454.CMB.2.raw
  modified_base (607)..(607): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggttgtccagtgcggaggggcgacgtgggcggagggtcggggggggcttgggcacgagccgagggcggtctcgtgagctctcctgtgtagtctcgaggtattcagtcttagtgtattatctacgttggccgtcgggtcctcgaggctccggaggggaggggtcttggaggtggatctacgtttcgacagtaacgtagtaaacgttagtagggtaggaaagtaaagcggtaacgccggtcgtcgtaggtaggaaaggggtaatacgtttccaacccggttctacggaaaggggtatacggaacctaccgaaaacgtggtttacgttacggacccttaagttttaaaccgaaattgaaacgtcctaaaaccgtacggaccgaacccccggaagaaccaacgtacgggtcttaactacgttaccgnggacccgaccctaggggccgtacgttccccggaaggggtccgtacgtagtcgacgtttagtttaggacttttagggg

SEQ ID NO: 400189 - DNA, 747 bp, Homo sapiens
  misc_feature: GZ8MTXP02INIR6.44.56.F01.1.454.CMB.2.raw
  modified_base (282)..(282): a, c, t, g, unknown or other
  modified_base (689)..(689): a, c, t, g, unknown or other
  modified_base (715)..(715): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcgggggggggcttgggcacgaggccgaggggcggtctcgtgagactctcctgtgtagtcncgaggtattcagttcttagtgtattatcctacgttggcccgttggggtccccgtcgacggcccgttacccggaagggggtaacggggtcttaggaagggttgggtacttaccgtaccgtttttccgacgaaggtaacgttaacgggtaaaacgtttaggtaggggttaagggtaaaaaggttaaacggtacggggttaaccgacccgggtacggtcgttaggggtaagggaaaagggggtaaatactttacccgacccggttactacggaaaggggtcttaacgaccttacccgaaaagttgggttcgttacgacctttaaattttaaaccaaaggttgaaccgacctaaacccgtggaaacccgaaccccgaacgacaaccggtaggtcttacttacgttacccgnggaccgacgacggacctacgtccggngggtaactgacgtcgacttagttgtacgtcgg

SEQ ID NO: 400190 - DNA, 706 bp, Homo sapiens
  misc_feature: GZ8MTXP02JXVQ5.44.56.F01.1.454.CMB.2.raw
  modified_base (624)..(624): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttggaaggtgtccagtgcggagggcgacgtgggcgggaggggtcggggggggggcttgggcgacgaggccgagggcggtctcgtgacgactctcctgtgtagtctcgaggtattcagttcttagtgtattatctacgttggccgttgggtcctcgaggtcctccggaggggacgggtcttggagtggatcgtacgtttcgcgaagtaactagtaaacgttagtagggtaggtaaagtaacgaggtaccgccggtcgttacgtaggtagggaaagggaatacgttaccgaacccggttcgtacggaaaaggggtcttacggacccttaccgaaacgtggttacgttcggaaccttaatttaaaccgaaagttcgaacgtacccgtaaaaccgtggaaacccgaccccggaacgtaaccaaggacgggtaccttacttaacgttacncgggaccgccggtaacgggccgtacgtaccccggtaggggaaccttacggatcggtatacggtttaggaacgtttacggggg

SEQ ID NO: 400191 - DNA, 576 bp, Homo sapiens
  misc_feature: GZ8MTXP02GGP8D.44.56.F01.1.454.CMB.2.raw
  modified_base (410)..(410): a, c, t, g, unknown or other
  modified_base (421)..(421): a, c, t, g, unknown or other
  modified_base (431)..(431): a, c, t, g, unknown or other
  modified_base (443)..(443): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagtttttttagaaggtgtccagtgcgaggggcgactggcggaggtcggggggggcttgggcacagccgaggggcggtctctggagactctcctgtgtagtctcgaggattcagtcttagtgattatctacgttggcctgggtcccgtgacggctccgagggaaggggcttggagtggatcactttcgcagaatgaaccgttagtggtagaagtaagagttacgccgcgtctggagaaggganattcgaccgtntacgaagggntagactcaacgngtgttcgactatttaacaaagtgacgacacgtgaacgacccgacgacacgacggcgtactacttacgcggcgacacgggcacgtccgtagggtccgtgaagtcgacttagttgagtttcggttacgggaccgg

SEQ ID NO: 400192 - DNA, 774 bp, Homo sapiens
  misc_feature: GZ8MTXP02JSFKB.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaacaatggagtttgggctaatcttgtattttccttgttagttttttagaaggtgtccagtgcggaggggcgacgtgggcgggagggtcgggggggggcttgggcacgaggccgaggggcggtctcgtgagactctccgtgtgtagtctcgaggtattcgagttcttagtgtattatctacgttcggccgtcggggtccctcgacggtcctaccggagggggaggggtcttggaggtggtacttcgtacgtttcgacgtagtaaacgtaggtaaaaccgttagtaggggttacggtaaaaggtaaaggaacgtaccgggcccggtacgttcggtaggtagggaaaggggtaacgtacgtttcccgaaccgttcgttaacgaaaggggtactacggaaccctacgaaacgtaggttcgttaacggacccttaatttaaacaaagttcggaacgtacctaaccggtggaaccgaacccccgaacgaccaacggtacggtcccgtttactaacgtttaccgtcgggaccccgtaccggacggggaccgtaaccggttcccggttacgggggaacccgtttagggaacgttccggtacgtttaaggttttcggtaaacggtttcgggggttttacgggggaaaccggg

SEQ ID NO: 400193 - DNA, 582 bp, Homo sapiens
  misc_feature: GZ8MTXP02F3OYJ.44.56.F01.1.454.CMB.2.raw
  modified_base (390)..(390): a, c, t, g, unknown or other
  modified_base (435)..(435): a, c, t, g, unknown or other
  modified_base (488)..(488): a, c, t, g, unknown or other
  modified_base (495)..(495): a, c, t, g, unknown or other
  modified_base (529)..(529): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtattttccttgttagttttttagaaggtgtccagtgcgagggcgacgtgggcgggagggtcggggggggggcttgggcacgagccgagggcggtctcgtgagactctcctgtgtagtctcgaggattcagtcttagtgattatcacgttgcctgggtcctgaggctcgagggagggtctggagtgatctacttgacagtactagtaaacgttagtgggtaggaaagtaagnggtaccgcgtgtcgtggtaggaaaggggtaatattccgaccggtntacggaagggtatacgacctaccgaaagtgtacgtgacctaattacaaatganaccaacngaacgacccgagacacgaggtctactacgtacgngccgacaggctaactccggagggaactcgaatggacttagtcgtattacgggg

SEQ ID NO: 400194 - DNA, 661 bp, Homo sapiens
  misc_feature: GZ8MTXP02IZMGZ.44.56.F01.1.454.CMB.2.raw
  modified_base (287)..(287): a, c, t, g, unknown or other
  modified_base (522)..(522): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttccttgttagttttttagaaggtgtccagtgcggaggggcgactgggcgggagggtcgggggggggcttgggcacaggccgaggggcggtctcgtgagactctccgtgtgtagtctcgaggtattcngttcttagtgtattactctacttggccgtgggtccgtcgaggccgtcgaggggaacgggtcgtttaggacggttaggatcttacctttgtacaaggtaaatacggtaaaccgttagtgggtaaggaaaagttaaaggagttaacggcgtcgtacgtgggtagaaggggaatatccgtacgtcgtacgaaagggatagaccgtactacgaagttcgtaggtacctaagtttaaaanaagtagaacgaacaacgtacgaaccgaaccgacgaccacgacgtcgtactacgtacgtacgacgacggacgtacgtacgtccgtacggtacgtacgtaacgtgtacgttagttacgtacggttacggtttacgggacgg

SEQ ID NO: 400195 - DNA, 790 bp, Homo sapiens
  misc_feature: GZ8MTXP02JFRQ6.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggtagttgggctaatcttgtatttttccttgtttagttttttagaaggttgtccaggtgcggaggggcgacgtgggcgggagggtcggggggggcttgggcacgagccgagggcggtctcgtgagactctctgtgtagtctgaggtattcagttcttagtgtattactctacgttggcccgtggggtacccgtcgtacgggccgtaccggaagggggtaacggggtcgttaggagggttggtacttccttaccgttttcgacgtaagtaagtaacggtaaacgtttagtagggtaaggaaaagtaaagtcggtaaccggccggtcgtacgtagggtagggaaagggtaatacgtttacccgaccggttcgtaaacggaaggggtactagtacccctaaccgtaacggtaggttacgttccggaaacctttaaagtttaaaccgaaaagttcggaaaccgtaacccgtaaaccgtaggaaaccccgaaccccggaacgaaccaacggtaccggtcgttaactttaacgttacccgaccgggcccggtaacccggaggggtacccgtaaacccggtttccggtaagggggtaaccccgttacggtacgttacgggtacctttagggttttacggtaacgttttacgggggg

SEQ ID NO: 400196 - DNA, 798 bp, Homo sapiens
  misc_feature: GZ8MTXP02FHS88.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagagtgtccagtgcgagggcgactggcggagggtcgggggggggcttgggcacgaggccgaggggcggtctctgagactctcctgtgtagctcaggattcagtcttagtgtattatcacttggcctggggtcctcgaggcctccgagggggaacggggtcttaggaaggtggacttaccgtaccgtttcggtaccaaggtaaagttggtaaaaaccggtttagttagggggttaagggtaaaagttaaaagggtcggtaacccggcccggtacggtttaccgttaggttaacggggaaaagggggtaaataccgtttaccgaaaccccgggttctaaaccggaaagggggtaacttacggaaacccttacccgaaaacggtaggttacggtttacggggaacccctttaaagttttaaaacccgaaagttacggaaacggtaacccgaaaacccgttacggaaaccggaaaccccccggaacggaacctaaccgggaaccggggtacttaacccgttaacgtttaccggaccggaccggaccccgtaggggacccgtaacgttccccggtaggggaaccgttacgaagttcggactttagtttacgagttttaacgggg

SEQ ID NO: 400197 - DNA, 563 bp, Homo sapiens
  misc_feature: GZ8MTXP02GDFMR.44.56.F01.1.454.CMB.2.raw
  modified_base (386)..(386): a, c, t, g, unknown or other
  modified_base (412)..(412): a, c, t, g, unknown or other
  modified_base (423)..(423): a, c, t, g, unknown or other
  modified_base (434)..(434): a, c, t, g, unknown or other
  modified_base (446)..(446): a, c, t, g, unknown or other
  modified_base (472)..(472): a, c, t, g, unknown or other
  modified_base (513)..(513): a, c, t, g, unknown or other
  modified_base (533)..(533): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgtagttttttagaaggtgtccagtgcgagggcgactggcggaggtcgggggggggcttgggcacgaggccgaggggcggtctctgagactctcctgtgtagtctcaggattcagtcttagtgattatcacttggcctgggtccgtcaggctccgaggggaggggcttggagtggatctactttcgcagaatagaaacgttatgggtagaaagtaagngtacgcgtcgtctgtagaaagggtanattcacccgtntacgaagggtntagactcgaaangtagtggacctatttaacaaatgaanaccaaactgacgacccgagaacacgagggctactattacgngcgaccgaggccgactccgnggggaactggactgctagtttcgaatttgg

SEQ ID NO: 400198 - DNA, 796 bp, Homo sapiens
  misc_feature: GZ8MTXP02IHFJB.44.56.F01.1.454.CMB.2.raw
  modified_base (282)..(282): a, c, t, g, unknown or other
  modified_base (287)..(287): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttggctaatcttgtatttttccttgttagttttttagaaggttgtccagtgcggaggggcgacgtgggcgggagggtcgggggggggtcttggcacagccgaggggcggtctctgagtctcttcctgtgtagtctnaggtnttcagtcttagtgattatctacgttcggcccgttggggtccctcgacggtcctaccgggaagggggtagggtcgtttaggacgggttcggtacttccgtaacgtttttccggactaaggtaaaccttagggtaaaaccgtttaggttaggggtaacggtaaaacggttaaaaggtacgggttaaccggcccgggtacggtttaccgttgggggttaaggggaaacgggggtaaaattaccgtttacccaacccgggtttgaacgggtaaagggtacgtcggaaacccctacccgtaaaacgttggttacggttcggtaacccttaaacgttttaaaacaaacggttcgaacgtaccaaacccgtcggaaaccccggaaacccgtaacgaaaccgtcgaaccgggtccgttaaccttaacgtttaccgccggaaccgtacccgaacggtccgaacttcccgggttaggggaaccgtacgaagtccgtacttggtttacgacgttttaggg

SEQ ID NO: 400199 - DNA, 715 bp, Homo sapiens
  misc_feature: GZ8MTXP02JQ7Y3.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttccttgttagttttttagaggtgtcagtgcggaggggcgacgtggcggagggtcggggggggcttgggcacgagccgaggggcggtctcgtgacgctctcctgtgtagtctcgaggtattcgagttcttagtgtattatcgtacgtttggccgtttcggggtcccgtgacggtccgtaccggaggggaacggggtcgttaggaggttgggacttcgtacgttttcggtacaagtaacgtacgtaaacgtttgtagggtaggaaaagtaagacggtaccgccggtcgttacgtgggtaagggaaagggtaactacgttcccgtaaccggttcgaacgggtaagggtacgtacgtaacctaaccgtaacgtaggttcggtacggtaccttaaagttttaaaccgaaaagttcggaaccgttaccgaaaccggtcgaaacccggtaacccgaacggtaccacgtacggtccgtacgttaacttacgcggtacgccggaggtaccgacgttccggaggtccgtacggtatcggtactagtttacgagtttacgggg

SEQ ID NO: 400200 - DNA, 712 bp, Homo sapiens
  misc_feature: GZ8MTXP02GN6QC.44.56.F01.1.454.CMB.2.raw
  modified_base (326)..(326): a, c, t, g, unknown or other
  modified_base (607)..(607): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagttggctaatcttgtattttccttgttagtttttttagaaggtgtccagtgcggaggggcgacgtggcgggaggggtcgggggggggtcttgggcacgaggccgagggcggtctcgtgagactctccgtgtgtagtctcgaggattcagttcttagtgtattatcacgttggccgtgggtcccgtnacggctccggaggggagggcttggagtggatctacgtttcgacagtaatagaaaccgttgtagggtagtaaagtaaagacggtaacgcccgtagtcgtaggtagtaaaggggaatacgttccaccggttcttaacggaaggggtatacgaacccgtacgaaaccgtaggttcgttacgtaccctagtttaaaccaaagtttggaacgtaccgtaaacccgttacggaaccggaacccccgaaagggaaccctacggaacgggtcctacttacgtttaaccnggaccggtaccgacggtaccgacgtttcccgggaacggggtcccgttacggaattcgggacctttacgtttggtaaaccgttgggttttaccgggggaaaccggg

SEQ ID NO: 400201 - DNA, 719 bp, Homo sapiens
  misc_feature: GZ8MTXP02GOEEK.44.56.F01.1.454.CMB.2.raw
  modified_base (647)..(647): a, c, t, g, unknown or other
  modified_base (689)..(689): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggagggcgacgtgggcggagggtcggggggggcttgggcacgagccgagggcggtctcgtgagctctcctgtgtagtctcaggtattcagttcttagtgtattatcgtacgttcggcccgttgggtcccgtcgaggtccgtaccggaagggggacggggtcgtttaggagggttggtacttccgttacgtttccggtactaagtaagttaacggtaaaacgtttagtaggggttaaggtaaaaggttaaacggtagggttaccggccggtacggttacgttagggtaagggaaaaggggtaattacgttaccgtaacccgtttgaaaccggaagggacttacgaccctaccgaaaagtggttgttaccgacctttaaattaacgaaaattcggaacaccaaaccgtgaaacccgacccggaagacacgtaggtcctacttacgttaccgnggaccgcgacggtcacgttcccggtaagggaacgttaccggngtacgtgtttaaggttcgtagtttacgggg

SEQ ID NO: 400202 - DNA, 623 bp, Homo sapiens
  misc_feature: GZ8MTXP02G5FRM.44.56.F01.1.454.CMB.2.raw
  modified_base (316)..(316): a, c, t, g, unknown or other
  modified_base (318)..(318): a, c, t, g, unknown or other
  modified_base (433)..(433): a, c, t, g, unknown or other
  modified_base (544)..(544): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggttgtccagtgcgagggcgacgtggcggaggtcgggggggggcttgggcacgagccgagggcggtctcgtgagactctctgtgtagtctcaggtattcagtcttagtgtattatcacttggcctgggtccngnggctccgaggggagggtcttggagtggatcgtactttcgacagtatagaaacttagaggttaggaaagttaaagagtacgcgtcgtactggtagaaagggaagattcgacccgtntacgaagggtatgaacctacaacaagtgttaggccctaagtttaacaaattgaacggtacaaaccctagaacgaccccgacgacgtaaccgaggccgtagttaaacttacncggtaccgccgaggtcgtaacgtccgttaggggaacccgttacggaacgtggacctaggtttacgtacggtttaacggg

SEQ ID NO: 400203 - DNA, 701 bp, Homo sapiens
  misc_feature: GZ8MTXP02F2V1F.44.56.F01.1.454.CMB.2.raw
  modified_base (430)..(430): a, c, t, g, unknown or other
  modified_base (449)..(449): a, c, t, g, unknown or other
  modified_base (481)..(481): a, c, t, g, unknown or other
tcagacagtatatacacgaccggtgctcgatttagcagacgtctgaacacacaaaggggagctctgggagaggagccccatccgtgagattcccaggagtttccacttggtgatcagcactgagcacagaccaccaaccatggagtttgggctaatcttgtattttcttgttagttttttagaaggtgtccagtgcggaggggcgacgtgggcgggaggggtcgggggggggggcttgggcacgaggccgaggggcggtctcgtgagactctcctgtgtagtctcgaggtattcgagttcttaggtgtatttatctacgttcggccgtggggtccgtcgaggtccgtccggaaggggaggggtcttggaggtggatctacgtttcgacagtaacgtagtaaacgttagtagggtaaggtaaagtaaaggnggtaccgccggtcgtacgnggtaaggaaagggtatatttccgaccggttanacggaaaggggtattacgaaccttaccgaaagtgggttacgttcgaaccttaatttaaacaaagtgaacgtactaaccgtagaaccggaccccgaacgaacacgtaacggtcgttacttaacttaccggcgacccgaccggtaaacgggcccgttaagtccccggttaagggggcccgtagaacgttggaccttttaagttagggtacttttaacggggg

SEQ ID NO: 400204 - DNA, 788 bp, Homo sapiens
  misc_feature: GZ8MTXP02IR1DW.44.56.F01.1.454.CMB.2.raw
tcagacagtatatacacgaccggtgctcgatttagcagacgtctgaacacacaaagggcctgggagaggagccccagccgtgagattcccaggagtttccacttggtgatcagcactgagcacagaccaccaaccatggagtttggctaatcttgtattttccttgttagttttttagaaggtgtcagtgcgaggggcgacgtgggcgggagggtcgggggggggcttgggcacgaggcccgaggggccggtctcgtgagactctcctgtgtagtctcgaggattcagttcttagtgtattatctacttggccgtcggggtcccgtcgacggccgtccggaaggggaagggggtcttggaagggttcggtattccgtaacgttttccgtactaaggtaaagttacggttaaaaccggtttagtaggggttaagggtaaaaggttaaaaggtacggttaaccggcccggggtacgttcggttagggtaacgggaaagggggtaaagtacgtttacccgaaccggttccgtaacggtaaaagggggacttaacgggaacccttaacccgaaacgttaggtttacggttaccgggacccttaaagtttttaaacaaaagttacgggaactaccgtaaacccgtagggaaacccgaaccccgaacgaaccaacggacggtccgttaactacgttaacgtcgccggacccgaagggccgtaacgtcccggtaaggggtcctacggtgtacgtacgtttagttaggttagtttacgggtttcgggggaaaccgg

SEQ ID NO: 400205 - DNA, 708 bp, Homo sapiens
  misc_feature: GZ8MTXP02G8JDB.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatctgtattttccttgttagttttttagagtgtccagtgcgagggcgacgtgggcggagggtcggggggggcttgggcacgaggccgagggcggtctcgtgagactctccgtgtgtacgtctacgaggtattcagttcttagtgtattatctacgttcggccgttaggggtcccctcgacggtccgtacccggaaggggtacggggtcgttggagggttggtactccgtacgtttccgagtagtaactagtaaacgttgtagggtagaaagttaagagttacgccgtagtcgtaggtaggaaagggatacgtacgtaccgtcgtacgaagggattacgtaccaccgtaaaacgtcggttagttaccggaaccttaagtttaaaccgaaagtagaaccgtaccgaaccgtacggaaccccgacccggaacgaccaaccggtacggtcccgttattacgtaccttaggcccgaccggacggtaccgtacgtaccgggttacgggaaccgtttaggacgtttacgtacgtttaacgttacggttacgtttaccgggg

SEQ ID NO: 400206 - DNA, 756 bp, Homo sapiens
  misc_feature: GZ8MTXP02I0MA3.44.56.F01.1.454.CMB.2.raw
  modified_base (616)..(616): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgaggggcgacgtggcggagggtcgggggggggcttgggcacgagccgagggcggtctcgtgagactctcctgtgtagtctcaggtatcgacgtcttagtgtaattagtcctacgtttcggccgttggggttccccgtcgacggtccttcccgggaagggggtaacggggtcgttagggaagggttggggaactttcccgtaacgttttttcccggacgtaaaggtaaacgttaacggtaaaacggttttagtaggggttaaggtaaaaggttaaaaggtacggggtacccgggtacccggtacgggttaccgttaggggttaagggaaaacgggggtaaagtacgtttaccgaacccggttacgtaaggaaacggtagtcgaccgtacaacgtagtggttcgaccttattaacgaagtnagcctaacgtcgacgacccgacgaacgacgtaacggcgttacttaacgtaccgttcgacccgtgaccgggtcgtaaccgttccggacgggtaacggttccgaaatttcggactttaggtttacgtaggttttaacggggg

SEQ ID NO: 400207 - DNA, 847 bp, Homo sapiens
  misc_feature: GZ8MTXP02I9RZ4.44.56.F01.1.454.CMB.2.raw
  modified_base (298)..(298): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgagggcacgtggcggaggtcgggggggcttggcacgagccgagggcggtctcgtgagactcgtctgtgtagtctcgaggtattcgagttcttagtgatttanctacgttcggccttcggggtcccgtcgacgggtccttacccggaggggtaacggggtcgtttaggaggttggaacttccgtaacgtttttcggacgtaacggtaacgttaggtaaaaccgtttgtaggggtttaacggtaaaacggttaaaacggtacggggttaaaccggtccccggggtaaccggtttccgttaggggttaaacggaaagggggtaaaacgttacgtttacccggaacccggtttaccgtaccgggtaaaagggggtctttacgggaccccttaacccgtaaaaccgttacggggtttggttaccggttaacccttaaacgtttttaaaccgaaaaacggtttggaaaccgtaccggtaaaacccgtagggaacccggaacccccgaacggaaaccgaccggaacgggtaccggtttaccttaaacggttaccgtcggaccccggtaaccgaaccggggccgtaaaccgttcccggttaacggggaacccgttggtacgtacggtaccttacggttttaggaacgtttttaacgggg

SEQ ID NO: 400208 - DNA, 739 bp, Homo sapiens
  misc_feature: GZ8MTXP02FSECR.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagttggctaatcttgtattttcttgttagtttttagaggtgtcagtgcggagggcgacgtgggcggagggtcgggggggggcttgggcacgagccgagggcggtctcgtgagacctctccgtgtgtagtctcgaggtattctagtcttagtgtattatccgtacgtttcggccgttcgggtcccgtcgacggtcctaccggaaggggacggggtcgttggaggtggtactcgtacgtttcggtacgtaagtaagtaggtaaacgttaggtagggtaaggtaaaaggtaaacggtacggtaccgccggtacgttacgtagggtaagggaaaggggtataacgttcccgaacccggttagtaacgggaaagggtactacgacccgttaaccgaaaacggttggttacggttaccggtaaccttaaagtttaaaccgaaaaggtcgaaacgtacccgtaaaccgtggaaacccggaacccccggataaacccgacgtaagggtccttaacttaacgtcgcggaccgtaccgaacgggtcctacgttccggtaggggaacttacggattcggacctttaggtttacgtagtttaccgggg

SEQ ID NO: 400209 - DNA, 671 bp, Homo sapiens
  misc_feature: GZ8MTXP02FYILK.44.56.F01.1.454.CMB.2.raw
  modified_base (291)..(291): a, c, t, g, unknown or other
  modified_base (653)..(653): a, c, t, g, unknown or other
tcagacagtatatacacgaccggtgctcgatttagcagacgtctgaacacacaaagggggagctctgggagaggagccccagccgtgagattcccaggagtttccacttggtgatcagcactgagcacagaccaccaaccatggagtttgggctaatcttgtattttcttgttagttttttagaaggtgtccagtgcgaggggcgacgtgggcgggagggtcgggggggggcttgggcacgagccgaggggcggtctcgtgagactctcctgtgtagtctcgaggtattcngttcttagtgtattatctacgttggcctgggtcccgtgacggcctaccggaagggggaaggggtcttaggaggtgggacttcgtacgtttcgtacgaagtaacttaggtaaaacgtttagtaggggtaaggtaaaaggttaaaaggtacgggtaaccggcccggtacggttcgtagggtaggaaagggggtaatactttccgaacccggttacacggaaaggggtatacggtaccctaccgaaagtggttagttcgaccttaatttaaacaagttgacgaacaacctgaccgaccccgagacacgaggtcctatacgttcaggccaccgaggcctacgtcccgtagggccgttagagtcgtntaagtttgatttacgggg

SEQ ID NO: 400210 - DNA, 621 bp, Homo sapiens
  misc_feature: GZ8MTXP02F3SOX.44.56.F01.1.454.CMB.2.raw
  modified_base (561)..(561): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcgggagggtcggggggggggcttgggcacgaggccgaggggcggtctcgtgagactctcctgtgtagtctcgaggtattcagttcttagtgtattatctacgttcggccgtgggtcccgtcgacggccgtccggaggggaggggtcttggaggtggatcctacgtttcgacagtaatagtaaacgttagtaggtaggaaagttaaggagtacgccgtcgtcgtggtagaaggggtatacttccgaccgttctaacgaagggtatacgacctaccgaaacgtgtgttacgacctaagtttaacaaatgacgacaacgtgacgacccagacacgaggtctatacgtacgngaccgacgaggctacgtcccgtaggggaactcgaatcggacttagttcgagtttacgggg

SEQ ID NO: 400211 - DNA, 608 bp, Homo sapiens
  misc_feature: GZ8MTXP02GOJEC.44.56.F01.1.454.CMB.2.raw
  modified_base (365)..(365): a, c, t, g, unknown or other
  modified_base (378)..(378): a, c, t, g, unknown or other
  modified_base (413)..(413): a, c, t, g, unknown or other
  modified_base (427)..(427): a, c, t, g, unknown or other
  modified_base (461)..(461): a, c, t, g, unknown or other
  modified_base (502)..(502): a, c, t, g, unknown or other
  modified_base (524)..(524): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcgagggcgactgggcggagggtcggggggggcttgggcacgaggccgaggggcggtctcgtgagactctcctgtgtagtctcgaggtattcagttctttagtgtattactctagttcggccgttgggtccctcgacggtctaccgaaggggagggtcttggaggtggtntcgtactttcganaagtaatagtaaacgttgaggtaggaaagttaagngtacgccgtgtcgnggtagaaagggactagtccgacgtcaggaagggntagacctacaagtagttgtcgaccttaattaagaattgganacgaactgaacgacccgagacnccgaggtctccttaatcgtacgcgacctaggggcctacgtcggttagggaacgtcgaagtcgtactagtttcgtaagtttcggg

SEQ ID NO: 400212 - DNA, 823 bp, Homo sapiens
  misc_feature: GZ8MTXP02GVHF4.44.56.F01.1.454.CMB.2.raw
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgtattttccttgttagttttttagaaggtgtccagtgcggaggggcgacgtgggcggagggtcgggggggggcttgggcacgaggccgaggggcggtctctgagactctcctgtgtagtctcgaggtattcagttcttaaggtgtaatttatctacgttcggccgttcggggtcccgtcgacggtccgtccggaaggggaaggggcgttcggagtggatctacgtttcgtacagtaactagtaaacgttagtaggggtaggtaaagtaaagacgtaacgccggtacgtcgtaggtacggaaagggtaataactttccgaacccgttcgtaacggaaagggggtacttacgggtaccctaaccgtaaaacggtggtttacggttacgggtaccccctttaaagtttttaaaacccgaaaaggttcgaaacggtaacccctaaaacccggtaggaaaacccggtaacccccgaacggaaacccacggttaacgggggtaccctttaacccggttaaaacttaaccccggggcggtacccccggtaaccgggtaacggggtacccggttaaaaccggttccccggggttaaaggggggtaaccccgttcggaaacggtttccggtaaccttttaagggttttacggtaaacgggtttttaccggggg

SEQ ID NO: 400213 - DNA, 680 bp, Homo sapiens
  misc_feature: GZ8MTXP02GIQX4.44.56.F01.1.454.CMB.2.raw
  modified_base (654)..(654): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgactggcggaggtcgggggggggcttgggcacgaggcccgaggggcggtctcgtgagactctcctgtgtagtctcaggtatcagttcttagtgtattatctacgttggccgtgggtcctcgaggtcctccggaggggagggtcttggaggtggatcgtacgtttcgactagaacgtagaaacgtttagtagggtaggaaaggttaaacgcggtaaccgccggtcgttacgtgtacggtaaaggggaactagttaccgaacccgtcgtaacggaaggggtactacggaacccttacgaaacgtggttgttacggacccttaaatttaaaccgaaagttagaacgtacccaaaccgtcgaaaccggtaccccgagaaccaagtacggcgttacctaacgttcgcggtccgacccgtaaggccgtaacgccggttaggggaacctcgtacgtanaccgttagttcggtaatttacggggg

SEQ ID NO: 400214 - DNA, 811 bp, Homo sapiens
  misc_feature: GZ8MTXP02H4B15.44.56.F01.1.454.CMB.2.raw
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttggctaatcttgtattttcttgttagttttttagaaggtgtccagtgcggaggggcgacgtgggcgggagggtcgggggggggcttgggccacgacgccgagggcggtctcgtgagactctctgtgtagtctcgaggtattcgagttctagtgtattatcgacgttcggccttgggtccgtgacggccttaccggaggggtaacggggtcttaggtaggtggtaacttcgtaccgtttcggtactaagaagttacggtaacccgtttaggtaggtaggaaaaggttaacgaacggtaccgccgtacgttacgtagggtagaaagggtaacgtacttccgaaccggttacacggaaggggtactacggtaccctaaacccgtaagtcggttaggttaaccggtccttaaaagtttaaacgaaacgttggtaaacgtacccgtaaaacccggttagggaaacccggaacccccgtaaggaaacccgttacggaacggggttacccgtacgttaaacttaacccggtcggtaacggtaaccccggtacgggtaccccggtaaacgtttcccccggggtaacggggttaccggtaccgggtaacgttacggtacggtttttaaacgttggttaaaacccggggtttggttttaaacccggggggaacccggg

SEQ ID NO: 400215 - DNA, 610 bp, Homo sapiens
  misc_feature: GZ8MTXP02H0PE9.44.56.F01.1.454.CMB.2.raw
  modified_base (282)..(282): a, c, t, g, unknown or other
  modified_base (394)..(394): a, c, t, g, unknown or other
  modified_base (433)..(433): a, c, t, g, unknown or other
  modified_base (586)..(586): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttcctgttagttttttagaaggtgtccagtgcgaggggcgacgtggcgggagggtcgggggggggcttgggcacgagccgaggggcggtctcgtgagactctcctgtgtagtctcaggnttcagtcttagtgtatatcacttggcctgggtcctgaggctccgaggggagggtctagagtggatacacgtttgtacagtaagtgtaaaacgttgtaggtaggaagtaaagngtacgcgcgtcgtgtacggaaaggatagttacacccgtnacgaaggggatacggaccaccaaacgtaggttcgtacggtaaccctaagttttaaaccgaaaattcgggaactacaaccgtgaaccgaccccgaacgacctaacgcgggtacttactacttagcgaccgccgaagccacgtccgtaggccgtnagtcggatttgttcgtaagtcggg

SEQ ID NO: 400216 - DNA, 640 bp, Homo sapiens
  misc_feature: GZ8MTXP02IPKGT.44.56.F01.1.454.CMB.2.raw
  modified_base (367)..(367): a, c, t, g, unknown or other
  modified_base (401)..(401): a, c, t, g, unknown or other
  modified_base (443)..(443): a, c, t, g, unknown or other
  modified_base (455)..(455): a, c, t, g, unknown or other
  modified_base (581)..(581): a, c, t, g, unknown or other
  modified_base (589)..(589): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcgggagggtcgggggggggcttgggcacgagccgaggggcggtctcgtgagactctctgtgtagtctcaggtattcagttcttagtgattatctacttggccgtgggtccgtgacggctccgaaggggagggcttgaggtggatctacgtttcganagaatagaaacgttagtggtaggtaaagtaaagnggtacgccgcgtacgtgtaggaaagggagattcgaaccgttnacgaaagggtanagacctaccgaaactagttcggtaggtaccctaaagtttaaccaaaagttcgaacgtaccaaaccgtcgaacgaaccccggaacgacctaacgagggtcccgtattacttacgtcgcccgtaccgngggaaccncgttccggtagggtaaccggtctaagtcgactacgtttggaaagtttcggg

SEQ ID NO: 400217 - DNA, 712 bp, Homo sapiens
  misc_feature: GZ8MTXP02HB76M.44.56.F01.1.454.CMB.2.raw
  modified_base (385)..(385): a, c, t, g, unknown or other
  modified_base (460)..(460): a, c, t, g, unknown or other
tcagacagtatatacacgaccggtgctcgatttagcagacgtctgaacacacaaaggggctgggagaggagccccagccgtgagattcccaggagtttccacttggtgatcagcactgagcacagaccaccaaccatggagtttgggctaatcttgattttccttgttagttttttagaaggtgtccagtgcggaggggcgacgtgggcgggagggtcgggggggggcttgggcacgaggccgaggggcggtctcgtggacgtactctccgtggtgtacgtctcgaggtacttcgagttcttagtgattatctacgttggcctgggtccctgaggctcgaggggaggcttggagtggatcactttcgacagaatagaaaccgttntagggtaggaaagtaaggacgtaccggccggcgttcgtaggtaggaaaggggtaagtacgttaccgaacccgttntaaccggaaaggggtactacggaaccctaccgaacgtaggttcggttaacggacccttaaagttttaaacgaaacttggaacgtaccgaaacccgttgggaaacccgtaacccccggaacgaaccacggtacgggtccttaccgtaacgtttaccgacggccgtaccggagggtacccgtacgttccgggacggggtaccttcggaatcgtaacgttatttacggatttaacggggttcgggggtaacccgg

SEQ ID NO: 400218 - DNA, 637 bp, Homo sapiens
  misc_feature: GZ8MTXP02HPEZU.44.56.F01.1.454.CMB.2.raw
  modified_base (284)..(284): a, c, t, g, unknown or other
  modified_base (295)..(295): a, c, t, g, unknown or other
  modified_base (321)..(321): a, c, t, g, unknown or other
  modified_base (377)..(377): a, c, t, g, unknown or other
  modified_base (393)..(393): a, c, t, g, unknown or other
  modified_base (445)..(445): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttccttgttagttttttagaaggtgtccagtgcgaggggcgacgtgggcgggaggtcgggggggggcttgggcacgagccgagggcggtctcgtgagactctcctgtgtagtctcgaggtnttcagtctagngtatatcacttggccttgggtccgtnaggctccgaggggacgggcttggagtggatcatttgtcagtaacgtagaaacgttntggtaggaaagtaagngtacgccgcgtcgtgtaggaagggaagtattccgaacgtccgtgaaagggtntagaccttacaacgtaggttcgttagacccgttatttaacaaagtttgaatactaacccggtgaaaccggtacccgaggaacctacgtaacggggcctacgttacttaacgcggaccgacccgagggtccgtaacgtcccggagggggtaacctcgggaaagtccggacttaagttttcggaagtttccggg

SEQ ID NO: 400219 - DNA, 823 bp, Homo sapiens
  misc_feature: GZ8MTXP02I4T0U.44.56.F01.1.454.CMB.2.raw
  modified_base (783)..(783): a, c, t, g, unknown or other
tcagacagtatatacacgaccggtgctcgatttagcagacgtctgaacacacaaagggggagctctgggagaggagccccagccgtgagattcccaggagtttccacttggtgatcagcactgagcacagaccaccaaccatggagttgggctaatcttgtattttccttgttagttttttagaaggttgtcctagtgcggaggggcgacgtgggcgggaggggtcggggggggggcttgggcgacgaggccgaggggcggttctcgtgagcctctctgtgtagtctcaggtattcagtcttagtgtatttatctacgtttcggcccgttggggttaccccgtcgtacgggtcccgttcccggggaaggggggtaacgggggtccgtttgggtaagggttcggggtaacttccgttaccgtttttccggtaacgtaaggtaaacgttacggtaaaacggttttaggtagggggttaaggggtaaaaaggttaaagggtacgggttaccggacccgggtacgggttacgttagggggtaaaggggtaaaagggggtaagttaacgttacccgaaccggttaccgttaaccggggaaaggggtaactacgggtaaaccctaccgtaaaacgtaggttacgggttaccggtaccgttaaacttttaaacgaaaacggttgaaaccgggtaccctaaaaccgttcgggaaaaccgtaccccggaagaaaccgaccggtacgggtacttacttacgtaccgtcggccgtacgacggtcgacgtccggnggtaaccgtggactcggacttagtttacgtacggtttggg

SEQ ID NO: 400220 - DNA, 570 bp, Homo sapiens
  misc_feature: GZ8MTXP02HNJ4V.44.56.F01.1.454.CMB.2.raw
  modified_base (385)..(385): a, c, t, g, unknown or other
  modified_base (395)..(395): a, c, t, g, unknown or other
  modified_base (422)..(422): a, c, t, g, unknown or other
  modified_base (511)..(511): a, c, t, g, unknown or other
tcagacagtatatacacgaccggtgctcgatttagcagacgtctgaacacacaaaggggagctctgggagaggagccccagccgtgagattcccaggagtttccacttggtgatcagcactgagcacagaccaccaaccatggagtttgggctaatcttgattttctgtagttttttagaaggtgtccagtgcgaggggcgactgggcggaggtcgggggggggcttggcacaggccaggggcggtctctgagacctctcctgtgtagtctcaggattcagtcttaggtgattatcacttggccttgggtccgtcaggctccgagggagggcttggagtggatcacgtttcgcagaactgaaacgttagtggtaggaaagtaaanggtacgaccnggtctgtagaagggagattcaccggtnacgaagggatgactcaaactagtgttgacatttacaaattgagacaaacgtgaacgtacccgacgacacgtaggcgtactacgttacgngtacgccagggccgatcccgtaggggaacgtcggaacgtggtaccatttgacgtttagg

SEQ ID NO: 400221 - DNA, 505 bp, Homo sapiens
  misc_feature: GZ8MTXP01EG6N5.15.28.C06.1.454.CMB.2.raw
  modified_base (351)..(351): a, c, t, g, unknown or other
  modified_base (494)..(494): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaaagccccaaaagtcctgatctctgccgctctactttgcaaagtgggtccatcaaggttcagcgcagtggatctgggacngaattcagtctcacatcagcagcctgcagcctgacgatttgtcaacttactacttggccaagtagcataataatacattcgtccgggagggaccgaaggtaaggaggatacaaacgaaactagttggcttggcaccaatcttnttcttcttctc

SEQ ID NO: 400222 - DNA, 504 bp, Homo sapiens
  misc_feature: GZ8MTXP01DJ9NM.15.28.C06.1.454.CMB.2.raw
  modified_base (355)..(355): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagccccaaaagtcctgatctctgccgcctctactttgcaaagtggggtccatcaaggttcagcggcagtggatctgggacngaattcagtctcaccatcagcagcctgcagcctgacgattttgcaacttactacttggcccaaagtgacataataatcaatttcggcggagggccaaaggtggagatcaaagaaactgttaggcttgcaccaatctgttcttcaattcc

SEQ ID NO: 400223 - DNA, 500 bp, Homo sapiens
  misc_feature: GZ8MTXP01C54U6.15.28.C06.1.454.CMB.2.raw
  modified_base (356)..(356): a, c, t, g, unknown or other
  modified_base (486)..(486): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtgggggtcccatcaaggttcagccggcagtggatctgggacngaattcagtctcacatcagcagcctgcagcctgacgatttgcaacttactactggccaagtgacataataatcaatttcggcggagggaccaagggtggagatacaaacgaactgaggcttgcacaatcngttcttcaattccc

SEQ ID NO: 400224 - DNA, 525 bp, Homo sapiens
  misc_feature: GZ8MTXP01DPXOY.15.28.C06.1.454.CMB.2.raw
  modified_base (199)..(199): a, c, t, g, unknown or other
  modified_base (510)..(510): a, c, t, g, unknown or other
tcagtctacgtagccacgaccggtgctcgatttagagctcacgtattgggtttgggggagtcagactcagtcaggacacagcatggacatgagggtccccgctcagcctccgtggggctcctgctgctctggctcccaggtgccaaatgtgacatccagatgacccagtctccgtccaccctgtctgcatctgtcgganacagagtcacatcactgccggcagtcagatatactaatggtgctggttcagcagaacaggaacacccaaagtcctgatctctcgccgcctcttactttgactaaaggtcgggtacccatacgaaggttcagccgcagtggatcgtagggacaagtaattcagtctacacatcagcagcctgcagcctgacgtatttcgactaacttactactgaccctaaagtcactaataaataatctacgtttcgggacggagggaaccaaggggtgaagataacaaacgaagtggttcggcttcggcactaattcgtnttcttcaacgttccc

SEQ ID NO: 400225 - DNA, 550 bp, Homo sapiens
  misc_feature: GZ8MTXP01BK9LX.15.28.C06.1.454.CMB.2.raw
  modified_base (268)..(268): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggttggctggttcagcagaaacaggaaanacccaaaagtcctgatctctcgccgcctctactttgacaaagtgggtacccatcaaggttcagcggcagtggatcgtagggacaagaattcaagtctacacatcagcagctgcagactcgacgtatttagtactaacttaactacttacggacaagtagacaataaataaatactagttacggtacgggacgggaaccgaaggtaaggaagaagtaacaaacgaaaccgtagttaggcgttacgaacacctaacttctcgttacttcgttaacgtttccccg

SEQ ID NO: 400226 - DNA, 514 bp, Homo sapiens
  misc_feature: GZ8MTXP01BS19Y.15.28.C06.1.454.CMB.2.raw
  modified_base (358)..(358): a, c, t, g, unknown or other
  modified_base (498)..(498): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtgggggtcccatcaaggttcagcggcagtggatcgtagggacngaattcagtctcaccatcagcagcctgcagcctgacgtattttgctaacttactactggaccaagtgacaataataatcaagtttcggcggtagggaccaagggtggaaggatacgaaacgaactgttaggcttgcaccntctgttcttcaatccc

SEQ ID NO: 400227 - DNA, 529 bp, Homo sapiens
  misc_feature: GZ8MTXP01A3IU4.15.28.C06.1.454.CMB.2.raw
  modified_base (360)..(360): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatatactaaatggtggcatggttcagtagaacagggaaagaccccaaaagtcctgatctctgccgcctctactttgactaaaggtcggggtaccatacgaaggttcagccggcaggtggatcgtagggaacngaattcagtctcaccatcagcagcctgcagcctagtacgtatttcgactaaacttactactgacctaagtcgactaataataatctagtttcggacgggaggaccgaagggtgaagatacgaaacgtaactggttggcttggcactaatctgttccttcaactttcccg

SEQ ID NO: 400228 - DNA, 489 bp, Homo sapiens
  misc_feature: GZ8MTXP01DZISK.15.28.C06.1.454.CMB.2.raw
  modified_base (362)..(362): a, c, t, g, unknown or other
  modified_base (374)..(374): a, c, t, g, unknown or other
  modified_base (383)..(384): a, c, t, g, unknown or other
  modified_base (386)..(386): a, c, t, g, unknown or other
  modified_base (388)..(389): a, c, t, g, unknown or other
  modified_base (391)..(391): a, c, t, g, unknown or other
  modified_base (393)..(393): a, c, t, g, unknown or other
  modified_base (399)..(399): a, c, t, g, unknown or other
  modified_base (409)..(409): a, c, t, g, unknown or other
  modified_base (414)..(414): a, c, t, g, unknown or other
  modified_base (416)..(416): a, c, t, g, unknown or other
  modified_base (452)..(452): a, c, t, g, unknown or other
  modified_base (465)..(465): a, c, t, g, unknown or other
  modified_base (468)..(468): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagccccaaaaagtcctgaatctctgccgcctctactttgcaaagtgggggtcccatcaaaggttcagccggcagtggatctggggacngaaattcagtcncaccatcannancnnancnatattncaactactangcagnanataataatatatcgtcggaggacgaaggaaggaganacaaacgaactgngcngcacaatctgttcttcttctc

SEQ ID NO: 400229 - DNA, 513 bp, Homo sapiens
  misc_feature: GZ8MTXP01BJSE4.15.28.C06.1.454.CMB.2.raw
  modified_base (354)..(354): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagccccaaaagtcctgatctctgccgcctctactttgcaaagtggggtccatcaagttcagccggcagtggatctgggacngaaattcagtctcaccatcagcagcctgcagcctgacgtattttgcaaacttactaacttggccaaagttgacaataataaatcatttcggcgtaagggaccaagggtggagatacaaacgaactgttaggcttgcaccaatctgttcttcgaattccc

SEQ ID NO: 400230 - DNA, 541 bp, Homo sapiens
  misc_feature: GZ8MTXP01EFOMT.15.28.C06.1.454.CMB.2.raw
  modified_base (436)..(436): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaacagggaaacgaccccaaaagtcctagatctctcgccgtccctctactttgactaaaggtcggggtacccatcgaaggttcagccggcagtggatcgtagggacaagaattcagtctcaccatcagcagcctgcagcctagacgtatttgactaacttactactgggacaagtnacaataataatcgtaagttcgggacgggtaagggaccgaagggtggaagatacgaaagaacgtgttaggcttgaacctacaatcgtattcttcgttaacttcccg

SEQ ID NO: 400231 - DNA, 516 bp, Homo sapiens
  misc_feature: GZ8MTXP01CFVTO.15.28.C06.1.454.CMB.2.raw
  modified_base (358)..(358): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaaggtggggtcccatcaaggttcagccggcagtggatcgtagggacngaattcagtctcaccatcagcagcctgcagcctgacgtatttgactaacttactactggccaagtgacaataactaatctatttcgggacggagggtaccaagggtgaagatacaaacgaactgaggcttgccacaatctgttacttcgaacttcccg

SEQ ID NO: 400232 - DNA, 523 bp, Homo sapiens
  misc_feature: GZ8MTXP01DVQ5O.15.28.C06.1.454.CMB.2.raw
  modified_base (367)..(367): a, c, t, g, unknown or other
tcagtctacgtagccacgaccggtgctcgatttagagctcacgtattgggtttgggggagtcagactcagtcaggacacagcatggacatgagggtcccgctcagctcctggggctcctgctgctctggctcccaggtgccaaatgtgacatccagatgacccagtctccgtccaccctgtctgcatctgtcggagacagagtcacatcacttgccgggcagtcagagtattactaaatggttgctggttcagcagaacagggaaacacccaaaagtcctgatctctgccgcctctactttgacaaaggtggggtcccatcgaaggttcagcgcagtggatcgtagggacaagaattcagtctcacntcagcagcctgcagcctgacgtatttgactaacttactactggaccaaagtcactaataatatctaagtttcggacggtaggaccgaagggtggaagactacgaaacgtaacgtggttacggcttagcctaacctcttctcgttcttcttcttccg

SEQ ID NO: 400233 - DNA, 551 bp, Homo sapiens
  misc_feature: GZ8MTXP01EG9MJ.15.28.C06.1.454.CMB.2.raw
  modified_base (272)..(272): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaacagggaaancccaaaagtcctgatctctgccgcctctactttgcaaagtggggtccatcaaggtcagccgcagtgatcgtagggacaagaattcagtctcacatcagcagctgcagcctgacgtatttcgactaactttactacttcggacctaaagtcgactaattaaataaattcaaagttttcgggacgggtaaggggaaccaaaggggtcggaagagtaccgaaaacgaaactggttacgggcttaggccacctaatcgtgttcctttccgttaagtttccccg

SEQ ID NO: 400234 - DNA, 574 bp, Homo sapiens
  misc_feature: GZ8MTXP01B1SC8.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagccggcagtggatcgtgggacngaaattcagtctcaccatcagcagcctgcagcctgacgtattttgctaacttactacttgggaccctaaagttgacaataaataaactctatttcgggcgggaagggtaccgaagggttgggaagaattacgaaaacggtaaaccgttggttagggcccttaggaacctaaccccgtaattccgttcgggttcctttaacccgttaagttttcccccg

SEQ ID NO: 400235 - DNA, 684 bp, Homo sapiens
  misc_feature: GZ8MTXP01CQO25.15.28.C06.1.454.CMB.2.raw
  modified_base (407)..(407): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtcctccgtccacctgtctgcatctgcggagacagagtcaccatcacttgccggcagtcagtagtaattactaaagtggttggcctggttcagcaagaaaccgaggaaacgacccaaaagtcctagactctctcgcccgtccttacttacgtttagacgtaaaggtcgggtaccctagtacgaaaggttcaggccggtacgaggtggatcgtaagggaacaagtaacttcgattcacacctancacgacacgccgtgacgacgtacgtacgtacgttactttacgaacttaaacctttacgtaaccgtacggtaacgtaagtacgtaactaaattaaacgttaacgttacgttaacgggttaccgggaaccgggtaaacggggtaaaccggtaaagggtaacggtaaacggttaaacgtaaaccgttaaacggtaaacgtacggttacggttccgttacgtaacccttaaccgttaacgtttccgttacgtttaccctttaaccgttaaccgtttccccg

SEQ ID NO: 400236 - DNA, 533 bp, Homo sapiens
  misc_feature: GZ8MTXP01C4D3L.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgatctctcgccgcctctactttgacaaagtggggtcccatcaaggttcagccggcagtgatcgtgggacngaaattcagtctacaccatcagcagcctgcagccttgacgtattttgactaaacttactacttcgggaccctaaaggttcactaataaataataccgtagtttcgggcgggaagggaccgaaagggtggaagatacaaaccgtaatgttggcttgcacaatctgttcttcaattccc

SEQ ID NO: 400237 - DNA, 544 bp, Homo sapiens
  misc_feature: GZ8MTXP01AJJJE.15.28.C06.1.454.CMB.2.raw
  modified_base (356)..(356): a, c, t, g, unknown or other
  modified_base (424)..(424): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagcggcagtggatctagggacngaattcagtctcacatcagcagcctgcagcctgactattttgactaacttactactgggaccaaggtnactaataaataatcgtaagtttcgggcgggtaagggaccaagggtgggagaagtacgaaaacgtaacgtggttacgggcttcggcacccgtaattccgtgttcctttcgaactttccccg

SEQ ID NO: 400238 - DNA, 579 bp, Homo sapiens
  misc_feature: GZ8MTXP01C26VT.15.28.C06.1.454.CMB.2.raw
  modified_base (361)..(361): a, c, t, g, unknown or other
  modified_base (442)..(442): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaaaccagggaaagaccccaaaagtcctagatctctcgccgcctcttactttgacaaagtggggtacccatcaaggttcagccggcagtggatcgtagggacnggaattcaagtctacaccatcagcagcctgctagcctgacgtattttcgactaacttactacttagggaccctaaaggttnactaattaaataatctaagtttcggacgggaacgggaccgaaagggtgggaagaacgtaacgaaaacgtaacgtggttacgggcttacggaaccaaccctaattcccgttagttccttaaccgttaacgtttccccg

SEQ ID NO: 400239 - DNA, 523 bp, Homo sapiens
  misc_feature: GZ8MTXP01C14HI.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgcctggttcagcagaaaccagggaaagccccaaaagtcctgatctctgccgcctctactttgcaaagtggggtcccatcaaggttcagccggcagtggatctagggacngaatcagtctacaccatcagcagcctgcagcctgacgtatttgctaacttactactggacctaaaggtcacaattaataatcaatttcggacggaggaccgaaggtggaaggatcgaaaacgtaactggttaggcttggcaccctaatcctgttctttcaatttccccg

SEQ ID NO: 400240 - DNA, 525 bp, Homo sapiens
  misc_feature: GZ8MTXP01EVHC2.15.28.C06.1.454.CMB.2.raw
  modified_base (358)..(358): a, c, t, g, unknown or other
  modified_base (430)..(430): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaagaccccaaaagtcctgatctctgccgcctctactttgacaaagtggggtccatcaaggttcagccggcagtggatctagggacngaattcagtctcaccatcagcagcctgcagccctgacgtattttgctaacttactactgggacctaaaggtnacaataataatcaagtttcggaccggaggaccgaagggtgaagatacaaacgaacgtgttaggcttagcacctaatctgttcttcgaactttccc

SEQ ID NO: 400241 - DNA, 532 bp, Homo sapiens
  misc_feature: GZ8MTXP01A090Q.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaagtgggtcccatcaaggttcagccggcagtggatcgtggggacaagaattcagtctcacatcagcagcctgcagcctgacgtattttgactaacttactactggacctaagtgactaataataatctagtttcgggcggaagggaccaagggtggaagatacgaaacgtaacgtggttgggcttggaaccacctaatctgttaccttcaacttccccg

SEQ ID NO: 400242 - DNA, 530 bp, Homo sapiens
  misc_feature: GZ8MTXP01AQASZ.15.28.C06.1.454.CMB.2.raw
tcagtctacgtagccacgaccggtgctcgatttagagctcacgtattgggtttggggggagtcagactcagtcaggacacagcatggacatgagggtcccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaaaccagggaaacgacccaaaagtcctgatctctcgccgcctctactttgctaaagtcggggtccagtcaaggttcagccggcaggtggatcgtagggacaagattcagtctcacatcagcagctgcagccctgacgtatttcgactaaacttactactgggaccaaaggtcactaataaataatcgtagtttcgggacggaagggaccgaagggtgggaagatacgaaacgtaagtgagggcttgcactaatctgttcttcaacgttcccg

SEQ ID NO: 400243 - DNA, 514 bp, Homo sapiens
  misc_feature: GZ8MTXP01AG96Y.15.28.C06.1.454.CMB.2.raw
  modified_base (355)..(355): a, c, t, g, unknown or other
  modified_base (508)..(508): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagcggcagtggatctgggacngaattcagtctcaccatcagcagcctgcagcctgacgtattttgactaacttactactgggccaaagtgacaataataatcaagtttcgggacggtagggaccaagggtggaagatacgaaacgaactgttggcttgcacaatctgttcttcncttccc

SEQ ID NO: 400244 - DNA, 553 bp, Homo sapiens
  misc_feature: GZ8MTXP01B0X51.15.28.C06.1.454.CMB.2.raw
  modified_base (354)..(354): a, c, t, g, unknown or other
  modified_base (429)..(429): a, c, t, g, unknown or other
  modified_base (535)..(535): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggctggttcagcagaaccagggaaagaccccaaaagtcctgatctctcgccgcctctactttgcaaagtcggggtccatcaaggttcagccggcagtgatctagggacngaattcagtctcacatcagcagcctgcagcctgacgtattttgactaactttactacttgggaccctaaaggttnacctaaattaaactaattacgtaagttttcggggacgggaagggtacccgaaagggtggaaggatacgaaaacgtaacgtggttggccttgaacacctaattcgtnttccttcaacgtttcccc

SEQ ID NO: 400245 - DNA, 547 bp, Homo sapiens
  misc_feature: GZ8MTXP01EWO5Q.15.28.C06.1.454.CMB.2.raw
  modified_base (355)..(355): a, c, t, g, unknown or other
  modified_base (426)..(426): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaacagggaaacgacccaaaagtcctgatctctgccgccttctactttgacaaagtcgggtccatcaaggtcagccggcagtggatcgtagggacngtaattcagtctacaccatcagcagcctgcagcctaggtactatttgctaacttactactggcctaaagtnactaataataatcgtagttcgggacggtacggaacgaagggtaaggaagttacgtaacgaaacgtacgtaggttcggttcttacgctactaacttcgtcgttcctttcgttaacgttcccg

SEQ ID NO: 400246 - DNA, 511 bp, Homo sapiens
  misc_feature: GZ8MTXP01DAR2G.15.28.C06.1.454.CMB.2.raw
  modified_base (353)..(353): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggcagtcagagtattactaaatggttgctggttcagcagaacagggaaagccccaaaagtcctgatctctgccgcctctactttgacaaagtgggggtcccatcaaggttcaggccggcagtggatcgtgggacngaattcagtctcacatcagcagcctgcagcctgactatttgctaacttactactggaccaagtgacataataatctaagtttcgggcggagggaccaagggtcggagatacgaaacgtaagtcggaggcttgcacctaatctgttcttcgaacttccc

SEQ ID NO: 400247 - DNA, 559 bp, Homo sapiens
  misc_feature: GZ8MTXP01CCQGX.15.28.C06.1.454.CMB.2.raw
  modified_base (197)..(197): a, c, t, g, unknown or other
  modified_base (348)..(348): a, c, t, g, unknown or other
  modified_base (360)..(360): a, c, t, g, unknown or other
  modified_base (374)..(374): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggcagtcagagtattactaaatggtggctggttcagcagaaacaggaaacacccaaagtcctgatctctgccgctctactttgacaaaggtgggtccatcaaggtcagccggcagtggatcgagggacngaattcagttcncacatcagcagccngcagcctagtacgtatttacgactaacttactactacggaactaagtcaactaataaataatacgtaacgttcggggacgggtaacgggaaccgaaagggtaaggaacgaacgtaacgaaacggtaacgtcggttacggcacgaactaaccgtaacttcgttcgttccttaacgttaacgtcccg

SEQ ID NO: 400248 - DNA, 526 bp, Homo sapiens
  misc_feature: GZ8MTXP01AQW5O.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagccggcagtggatctagggacaagaattcagtctcaccatcagcagcctgcagcctgacgtattttgctaaacttactaactggccaaagtgactaataataatcatttcgggcgggtaagggaccgaaaggtggaagagtacaaacgaaacgtgttacgggcttagcaccaatctgttacttcaattccc

SEQ ID NO: 400249 - DNA, 530 bp, Homo sapiens
  misc_feature: GZ8MTXP01EQKGJ.15.28.C06.1.454.CMB.2.raw
  modified_base (429)..(429): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagaccccaaaagtcctgatctctgccgcctctactttgacaaagtgggtccatcaaggttcagccggcagtggatcgtagggacaagaattcagtctacacatcagcagcctgcagcctagaccgtatttgctaacttactactggaccaaggtnacaataataatctagtttcgggacgggtaggaccgaagggtggaagatacgaaaacgacgtgttaggcttggaacaccaatcgtagttcttcaacttcccc

SEQ ID NO: 400250 - DNA, 522 bp, Homo sapiens
  misc_feature: GZ8MTXP01CTQF9.15.28.C06.1.454.CMB.2.raw
  modified_base (348)..(348): a, c, t, g, unknown or other
  modified_base (514)..(514): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaacaggaaagcccaaaagtcctgatctctgccgcctctactttgcaaagtgggtccatcaaggttcagccgcagtggatcgtagggacngaattcagtctcacatcagcagcctgcagcctgacgtatttgactaacttactactgggacctaaggttcactaataaataatctaagtttcgggaaggaacggggaaccgaagggtggaagattacgaaacgtaaactgttaggcttgcaccaatctgttcttcncgttcccg

SEQ ID NO: 400251 - DNA, 511 bp, Homo sapiens
  misc_feature: GZ8MTXP01DN7B6.15.28.C06.1.454.CMB.2.raw
  modified_base (342)..(342): a, c, t, g, unknown or other
  modified_base (409)..(409): a, c, t, g, unknown or other
  modified_base (492)..(492): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggccagtcagagtattactaaatggtgctggttcagcagaacaggaaagcccaaaagtcctgatctctgccgcctctactttgcaaagtgggtccatcaagtcagcgcagtgatcgtagggacngaatcagtctcacatcagcagcctgcagcctgacgtatttgactaacttactactggaccctaagtnactaataataatcgtaatttcgggacggtaacgggaccgaaagggtggaagatacgaaacgtaactgttaggcttagcacctntctgttcttcaactttccc

SEQ ID NO: 400252 - DNA, 748 bp, Homo sapiens
  misc_feature: GZ8MTXP01DVQ3T.15.28.C06.1.454.CMB.2.raw
tcagtctacgtagccacgaccggtgctcgatttagagctcacgtattgggtttggggagtcgagactcagtcaggacacagcatggacatgagggtccccgctcagctcctgggctcctgctgctctggctcccaggtgccaaatgtgacatccagatgacccagtctccgtccaccctgtctgcatcgtgtcggagacagagtcacatcacttgccggccagtcagagtatactaaatggtgctggttcagcagaaacagggaaacaccccaaaagtcctgatctctcgccgcctcttaactttgactaaacggttcgggggtacccagtacgtaaaggttcgaacggccgggaccaagggttgggaacgttccggttaagggggaaaccaaggggtaaacgttttacctaaacgggttcccttaccgaaacccctaaagttccccaaagggtccctaaacgggtcccccgtaccgtaccgtaccggtaccgttacggttaacgtttaacgttttacgttaaccttaaacctttaaccgttaaccgttacgggtaaccgtaaacgttaacgtaactaaacttaaattaaacgttaacgttaacggtttacgggtaacggggtaaacgggtaacgggtaaacgggtaacgggtaacggttaaacgtaaacgttaaaacgtaaacggttacggttacggttcgttacgtaacgtaccgtaacgttcgttcgttccttcgttcgttcccg

SEQ ID NO: 400253 - DNA, 543 bp, Homo sapiens
  misc_feature: GZ8MTXP01EUG4H.15.28.C06.1.454.CMB.2.raw
  modified_base (358)..(358): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaacagggaaagcccaaaagtcctgatctctgcccgtcctctactttgactaaagtggggtcccatcaaggttcagccggcagtggatcgtagggacngaaattcagtctcaccatcagcagcctgcagcctagacgtatttgactaaacttactactgggccaaagttgacaataaactaattcgtaagtttcgggacgggtagggaaccgaagggtggaagatacgaaacgaactggttcggcttggcacctaattctgttaccttcgttaacgttccccg

SEQ ID NO: 400254 - DNA, 507 bp, Homo sapiens
  misc_feature: GZ8MTXP01C2RHU.15.28.C06.1.454.CMB.2.raw
  modified_base (267)..(267): a, c, t, g, unknown or other
  modified_base (346)..(346): a, c, t, g, unknown or other
  modified_base (371)..(374): a, c, t, g, unknown or other
  modified_base (383)..(383): a, c, t, g, unknown or other
  modified_base (406)..(406): a, c, t, g, unknown or other
tcagtctacgtagccacgaccggtgctcgatttagagctcacgtattgggtttgggggagtcgagactcagtcaggacacgagcatggacatgagggtcccgctcagctcctggggctcctgctgctctggctcccaggtgccaaagtgtgacatccagatgacccagtctccgtccacctgtctgcatctgtcggagacagagtcaccatcacttgccggcagtcagagtattacaaatggtgctggttcagcagaacagggaaanccccaaaagtcctgatctctgccgctctactttgcaaagttggggccatcaagttcagccggcagtggatcgtgggacngaattcagtctcacatcagcagccnnnnctgatattntactactactactacgacagtanactaataataatactacgttcggtacggacggaacgaaggtaaggagaagtaacgaaacgtaacgtagttgcgttcgaacactaactctcttcttcttctc

SEQ ID NO: 400255 - DNA, 584 bp, Homo sapiens
  misc_feature: GZ8MTXP01AKNPD.15.28.C06.1.454.CMB.2.raw
  modified_base (470)..(470): a, c, t, g, unknown or other
  modified_base (563)..(563): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcacttattggatgacttgggtccgccaggcctccgaggggaaggggctgggagtgggtcggccaaccataacaaaaagatgggaaagtgacacaaacctatagtagaactctgtgagtgggcattccaccgtctcctcacgccctacccaccgaacgggccccagtcccggttcccttcccccgnggcccgcccgtgcctccacggcgccaccgtccgacgcgcacacgccggccgtgggctcgccgtggtccaacggcttaccgttccgcttaacgngtacgttcggaacggcgggcg

SEQ ID NO: 400256 - DNA, 525 bp, Homo sapiens
  misc_feature: GZ8MTXP01DM1RP.15.28.C06.1.454.CMB.2.raw
  modified_base (356)..(356): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaacagggaaagacccaaaagtcctgatctctgccgcctctactttgcaaagtggggtcccatcaaggttcagccggcagtggatcgtagggacngaattcaagtctcaccatcagcagcctgcagcctgacgtattttgactaacttactactggaccaaaggttcacaaataaataatctaaagtttcgggacggaagggaccaagggtggaagatacaaagtaactgttaggcttgcactaatctgttcttcgaatttccc

SEQ ID NO: 400257 - DNA, 501 bp, Homo sapiens
  misc_feature: GZ8MTXP01A1LF8.15.28.C06.1.454.CMB.2.raw
  modified_base (349)..(349): a, c, t, g, unknown or other
  modified_base (416)..(416): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgctctactttgcaaagtggggtccatcaagttcagcgcagtggatctgggacngaattcagtctcaccatcagcagcctgcagcctgacgtatttgctaaacttactactggaccaagtnacataataatcaatttcggacgagggaccaagggtgaagatacaaagaactgttgggcttgcaccaatcctgttcttcaattccc

SEQ ID NO: 400258 - DNA, 550 bp, Homo sapiens
  misc_feature: GZ8MTXP01DSWG2.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaaaccagggaaagccccaaaagtcctgatctctgccgcctctactttgcaaagtgggtccatcaaggttcagccggcagtgatcgtagggacngaattcagtctacaccatcagcagctgcagccctgacgtatttgacctaaattactactggaccaaagtgacaataaataatctaagtttcgggcggaagggaccaaaggggttcggaaagattaaccgaaaacgtaaaccgtgttacgggccttaggaacctaaccaattcgtgttaccttcgttaacgtttccccg

SEQ ID NO: 400259 - DNA, 568 bp, Homo sapiens
  misc_feature: GZ8MTXP01AV2YJ.15.28.C06.1.454.CMB.2.raw
  modified_base (270)..(270): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacagggaaacncccaaaagtcctgatctctgccgcctctactttgcaaagtcgggtccatcaaggttcagccggcaggtgatcgtagggacaagatcagtctacacatcagcagcctgcacgcctgtaccgtattttcgactaacttactactgggacccaagttgactaataaatatctaagtttcgggacggtaacgggaccgtaaaggggtcggaagagttaaccgaaaaccggtaacgttggttacgggcttacggaacctaaccctaattccgttcggtttacctttaacgaaccttttccccg

SEQ ID NO: 400260 - DNA, 589 bp, Homo sapiens
  misc_feature: GZ8MTXP01ACZT4.15.28.C06.1.454.CMB.2.raw
  modified_base (425)..(425): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgctctctgccgcctctactttgcaaagtggggtcccatcaaggttcagccggcagtggatcgtagggacaagaattcagtctcaccatcagcagctgcagcctggactatttgctaacttactactgggaccaaaggtnactaataactaaatcgtaaagtttcggggcggaaggggtacccaaagggttcgggaacgttaagttaaccgaaaaccgggaaacgttgggttacggggccttacgggaacccaaccccgtaagtttccttacgggttacccttttcccgaagttttcccccccg

SEQ ID NO: 400261 - DNA, 495 bp, Homo sapiens
  misc_feature: GZ8MTXP01ESHT1.15.28.C06.1.454.CMB.2.raw
  modified_base (172)..(172): a, c, t, g, unknown or other
  modified_base (298)..(298): a, c, t, g, unknown or other
  modified_base (377)..(377): a, c, t, g, unknown or other
  modified_base (381)..(381): a, c, t, g, unknown or other
  modified_base (392)..(392): a, c, t, g, unknown or other
  modified_base (416)..(416): a, c, t, g, unknown or other
  modified_base (463)..(463): a, c, t, g, unknown or other
  modified_base (465)..(465): a, c, t, g, unknown or other
  modified_base (472)..(472): a, c, t, g, unknown or other
  modified_base (485)..(495): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaagggctggagtgggtggccaccatacaaaaagntggaagtgacacaacctatgtgaactctgtgatgggccgattcaccgtctccagagacgacgccaaagaactcactacatctgcaaatgaacaacctgagagccgaggacacggctgtgtacttangtgtgagagatgttctgcgttggggccaggaccctggtcacgtctctcagctcacaaggcccaatcggtccttccccgngccncctgctcagcncactcgagacacacgcgccgccgnggctcgcgtcgggtacgaacgtactacgtaccgtcgtacgtagacgngngcggcgngcgacgcgcagannnnnnnnnnn

SEQ ID NO: 400262 - DNA, 522 bp, Homo sapiens
  misc_feature: GZ8MTXP01EQBHS.15.28.C06.1.454.CMB.2.raw
  modified_base (379)..(379): a, c, t, g, unknown or other
  modified_base (381)..(381): a, c, t, g, unknown or other
  modified_base (383)..(383): a, c, t, g, unknown or other
  modified_base (422)..(422): a, c, t, g, unknown or other
  modified_base (424)..(424): a, c, t, g, unknown or other
  modified_base (500)..(500): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtggctggttcagcagaaaccagggaaacgcccaaaagtcctgatctctgccgctctactttgcaaagtgggtccatcaaggtcagcggcagtggatctagggacaagtaaattcagtctacaccaatcagcacncngnacgctagtatattatactaactactactacgacaagtananaataaataatactagttacggtacgggacgggaacgaaggtaaggaagaagtaacgaaacgaacgtgttgcgttcncactaactctcttcttcttctc

SEQ ID NO: 400263 - DNA, 558 bp, Homo sapiens
  misc_feature: GZ8MTXP01B0AG2.15.28.C06.1.454.CMB.2.raw
  modified_base (360)..(360): a, c, t, g, unknown or other
  modified_base (429)..(429): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcaagaaaccagggaaacgacccaaaagtcctgatctctcgccgcctctactttgactaaagtcgggtcccatcaaggttcagccgcagtggatcgtagggacngaatcagtctacacatcagcagcctgcagcctgacgtatttgactaacttactactgggacctaaagtnactaataaatatacgtacgttcggacgggacggaacgaagggtaaggaagaactaaaccgaaacgtacgtggttacggccttacgaacctaacctaacgttctcgttaccttaaccgttaacgttcccg

SEQ ID NO: 400264 - DNA, 522 bp, Homo sapiens
  misc_feature: GZ8MTXP01A2X55.15.28.C06.1.454.CMB.2.raw
  modified_base (349)..(349): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggttggctggttcagcagaaacagggaaagccccaaaagtcctgatctctcgccgcctctactttgcaaagtgggtccatcaaggttcagcggcagtgatctagggacngaattcagtctcacatcagcagcctgcagcctgacgtatttgactaacttacgtactgggacctaaagtgactaataataatcgtaagtttcgggcggtaagggaccaagggtggaagatacgaaacgaaactggttcggcttcggcaccaatctgttcttcaacgtttcccg

SEQ ID NO: 400265 - DNA, 557 bp, Homo sapiens
  misc_feature: GZ8MTXP01CEBV5.15.28.C06.1.454.CMB.2.raw
  modified_base (354)..(354): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagacccaaaagtcctgatctctgccgcctctactttgcaaagtgggtccatcaagttcagccggcagtggatctagggacngaattcagtctcacatcagcagcctgcagcctgacgtattttgcctaacttactactggacctaaagtgactaataaataatctaagtttcggacggaagggaccgaaagggttgggaagacgttaacgaaaacggtaaaccgttggttcgggccttggaacctaccctaatcccttaggttcttaaccgttaactttccccg

SEQ ID NO: 400266 - DNA, 513 bp, Homo sapiens
  misc_feature: GZ8MTXP01BPECF.15.28.C06.1.454.CMB.2.raw
  modified_base (356)..(356): a, c, t, g, unknown or other
  modified_base (424)..(424): a, c, t, g, unknown or other
  modified_base (487)..(487): a, c, t, g, unknown or other
  modified_base (497)..(497): a, c, t, g, unknown or other
  modified_base (507)..(507): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtccatcaaggttcagccggcagtggatcgtagggacngaattcagtctcacatcagcagcctgcagcctgacgtatttgactaacttactactgggaccaaggtnacaataaataatctagtttcggacggaagggtaccaagggtggaagagtacaaacgtaactgnggcttgcacntctgttctcncgttcc

SEQ ID NO: 400267 - DNA, 643 bp, Homo sapiens
  misc_feature: GZ8MTXP01B2ZPY.15.28.C06.1.454.CMB.2.raw
  modified_base (363)..(363): a, c, t, g, unknown or other
  modified_base (376)..(376): a, c, t, g, unknown or other
  modified_base (382)..(382): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctccaggtgccaaatgtgacatccagatgaccagtctccgtccacctgtctgcatcgtgcggagacagagtcaccatcacttgccgggcagtcagatattactaaatggtgctggtcagcagaaacaggaaacacccaaaagtcctagactctctcgccgccttctacgtttcgacgaaaggtcgggtaccagtacgaaggttcacggccggacaggtgatcgtagggaacngtaactcagttcncaccanacacgctacgcctacgcgacgtacgtacgtacgttacgttacgtaaccttaacttaacttacgtacggtaacgtaacgtacgtaactaaacttaaattaacgttaacgttacggttacgggtaacggggtaacgggtaaaccgggtaaagggtaagggtaacggttaaacgtaaacgttaaacggtaaacggtacggttacggttcgttacgtaaccgtaccgtaacgttcgttacgttacttaaccgttaaccgttcccg

SEQ ID NO: 400268 - DNA, 520 bp, Homo sapiens
  misc_feature: GZ8MTXP01A30EA.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtccatcaaggttcagccggcagtggatcgtagggacngaaattcagtctcaccatcagcagcctgcagcctgacgtattttgctaacttactactcgggccaaagtgactaataaataatcagtttcgggacggagggaccaagggtggaagatacgaaacgaacgtgttaggcttgccacaatctgttcttcaacttccc

SEQ ID NO: 400269 - DNA, 561 bp, Homo sapiens
  misc_feature: GZ8MTXP01CLLOS.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccgggcagtcagagtattactaaatggtggcctggttcagcagaaaccaggaaacgacccaaaagtcctgatctctgccgcctctactttgactaaagtcggggtacccatcaaaggttcagccggcagtggatcgtagggacaagaaattcaagtctcaaccatcagcagcctgcacgactcgacgtatttagtacaacttaactacttacggacctaagtagacaataaataaatactagttacggtacgggacgggaaccgaaggtaaggaagaagtacgaaacgaaacgtagttaggttcgttacggaacaccaactctcgttcttccgttaacgtttcccg

SEQ ID NO: 400270 - DNA, 604 bp, Homo sapiens
  misc_feature: GZ8MTXP01CM1M8.15.28.C06.1.454.CMB.2.raw
  modified_base (462)..(462): a, c, t, g, unknown or other
tcagtctacgtagccacgaccggtgctcgatttagagctcacgtattgggtttggggggagtcagactcagtcaggacacagcatggacatgagggtccccgctcagctactggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagacagaaaccaggggaaacgaccccaaaagtccctagaactctctcgcccgccttcttactttgacaaaggtcgggggtcccatcgaaaggttcagccggcagtggatcgtagggacaagtaattcagtctcaaccatcagcagcctgcacggcctagtacgtattttcgactaaactttactacgttggaccctaaggttanaactaataaatacgtacgttacggttcgggacgggtaacgggaacgtaaggggtaaggaacgaacgtaaacggaaacggtacgtggttacggttcgttacgaacctacgtaacttcgttcgttaccttaacgttcgttcccg

SEQ ID NO: 400271 - DNA, 503 bp, Homo sapiens
  misc_feature: GZ8MTXP01BFFQG.15.28.C06.1.454.CMB.2.raw
  modified_base (170)..(170): a, c, t, g, unknown or other
  modified_base (304)..(304): a, c, t, g, unknown or other
  modified_base (381)..(381): a, c, t, g, unknown or other
  modified_base (495)..(503): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaagggctggagtgggtggccaccatacaaaagntggaagtgacacaacctatgtgaactctgtgatgggccgattcaccgtctccagagacgacgccaaagaactcactacatctgcaaatgaacaacctgagagccgaggacacggctgtgtattactgtgtgagngatgttctgcggttgggggccagggaccctggtcaccgtctcctcagcctcacaggcccatcggtctcccctggccnccctgctccagacgccacctccgagacgacacacgccggccctggggcctcgccgtggggtcaagggtcctacgttccgctacgtagactgagcgggctggcaaggcgcagagnnnnnnnnn

SEQ ID NO: 400272 - DNA, 548 bp, Homo sapiens
  misc_feature: GZ8MTXP01C7Y61.15.28.C06.1.454.CMB.2.raw
  modified_base (282)..(282): a, c, t, g, unknown or other
  modified_base (326)..(326): a, c, t, g, unknown or other
  modified_base (419)..(419): a, c, t, g, unknown or other
  modified_base (530)..(530): a, c, t, g, unknown or other
  modified_base (532)..(532): a, c, t, g, unknown or other
tcagtctacgtagccacgaccggtgctcgatttagagctcacgtattgggtttggggggaagaggaagactgaaggcctttccacttggtgatcagcactgagcacagaggactcaccatggaattggggctgagcgtggtttcctgtagctattttagaaggtgtccagtgtgaggtgcaactggtggagtctgggggagcctcgtccaggccggggggtccctgagactctctgtgaagcctctggattcaccttgagcacttatggatgacttgggccncaggctcgagggagggctggagtgggtgccacataacaaaaagntaggaagtgacacaactatgtagacctgtgtgagtcggacctattccaccgtcacgagacgacgacgacaagtactcactacatacagacaanacgaacaacagacgacgacgggacggacgacgacgtgtagtagttagtgtgtagagagtgtgtgttggtcggttcgggcggtacggaccgttcgttcgtccgtcctcctcncncctccgaaccgaaccg

SEQ ID NO: 400273 - DNA, 545 bp, Homo sapiens
  misc_feature: GZ8MTXP01EFJ3E.15.28.C06.1.454.CMB.2.raw
  modified_base (354)..(354): a, c, t, g, unknown or other
  modified_base (426)..(426): a, c, t, g, unknown or other
tcagtctacgtagccacgaccggtgctcgatttagagctcacgtattgggtttgggggagtcagaatcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagagtattactaaatggttgctggttcagcagaacagggaaacacccaaaagtcctgatctctcgccgcctctactttgcaaaggtcggggtccatcaaggttcagccggcagtggatcgtagggacnggaattcagtctcaccatcagcagcctgcagcctgactatttgactaaacttactactcggacctaaggtanactaataaataacttcgtaagttttcggggcgggtaacgggaccgaaggggtaaggaagataacgaaacgtaacgtggttcggcttcgcactaattctgttcttcgttaacgttccccg

SEQ ID NO: 400274 - DNA, 602 bp, Homo sapiens
  misc_feature: GZ8MTXP01A7KE8.15.28.C06.1.454.CMB.2.raw
  modified_base (197)..(197): a, c, t, g, unknown or other
  modified_base (251)..(251): a, c, t, g, unknown or other
  modified_base (283)..(283): a, c, t, g, unknown or other
  modified_base (383)..(383): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttcggccggcagtcagtagtatactaagtggtgctgtnagcagaacaggaacacccaaagtctgatctcncgccgcctctactttgacgtaaaggtcgggtaccagtacgaaggttcaggccggcaggtggacgtcgtagggaacaagtaattcagtcctacaccatcancacgctcgcagtacctgtacgttatttacgacttaacttactaccgtacgtaccgtaaagtcgaactaattaaacttaacgtacgttaacggttccgggaacggggtaacggtaaccggtaaggggtaacggaaagttaacgtaacgaaaacgtacgtggttacgcttacgtaacctacccgtaagtccttacgttccttaaccttaaccgtttccccg

SEQ ID NO: 400275 - DNA, 522 bp, Homo sapiens
  misc_feature: GZ8MTXP01BFCYJ.15.28.C06.1.454.CMB.2.raw
  modified_base (358)..(358): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgccccaaaagtcctgatctctgccgcctctactttgcaaagtggggtcccatcaaggttcagccggcagtggatctagggacngaattcagtctcaccatcagcagcctgcagccctgacgtattttcgctaacttactacttgggccaagtgacataataatactatttcgggcggtagggaccgaagggtggaagatacgaaacgaaactgttaggcttggcacctaatctgttctcaacttccc

SEQ ID NO: 400276 - DNA, 539 bp, Homo sapiens
  misc_feature: GZ8MTXP01A6FPK.15.28.C06.1.454.CMB.2.raw
  modified_base (197)..(197): a, c, t, g, unknown or other
  modified_base (447)..(447): a, c, t, g, unknown or other
  modified_base (524)..(524): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccggcagtcagatattactaaatggttggctggttcagcagaaaccagggaaacgaccccaaaagtcctagatctctcgccgcctctactttgactaaacgggttcggggtcccagtcaaaggttcaggtccggcaggtggatcgtaagggacaaggaattcagtctacacatcagcagcctgcagcctagaccgtattttacgactaacttactactgggtaccaaaggtnacaataatatcagtttcggaggtagggaccaagggtgacggatacgaaacgaactgttaggcttcgaacacaatctnttctcttaattcccg

SEQ ID NO: 400277 - DNA, 585 bp, Homo sapiens
  misc_feature: GZ8MTXP01BNHR3.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagtagtattactaaagtggttggctggttcagcaagaaaccgaggaaacgacccaaaagtcctgatctctcgccgcctctactttgacgtaaaggtcgggtccatacgaaggttcaggccgcagtggatcgtagggacaagtaatcagtctacacatcagcacgctgcagcctagtacgtatttcgactaacttactactggactaagtcgactaataaataatctaacgttcgggacgggtaacgggaaccgaagggtaacggaagaacgtaaccgaaaacgtaacgttcgggttcgggttccttacggaacctaaccgtaacttccgttcgttaccctttccttaacgtttcccccg

SEQ ID NO: 400278 - DNA, 520 bp, Homo sapiens
  misc_feature: GZ8MTXP01CJPUD.15.28.C06.1.454.CMB.2.raw
  modified_base (353)..(353): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacagggaaagccccaaaagtcctgatctctgccgcctctactttgcaaagtgggtcccatcaaggttcagccggcagtgatcgtgggacngaattcagtctcaccatcagcagcctgcagcctgacgtattttgctaaacttactactggcccaaaggttgacaataaataatcagtttcggcggtagggaccaagggtggaagatacgaaacgtaaactggttggcttggcacctaatctgttcttcaagtttccc

SEQ ID NO: 400279 - DNA, 524 bp, Homo sapiens
  misc_feature: GZ8MTXP01ATQZ4.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccagggaaagccccaaaagtcctgatctctgccgcctctactttgcaaagtgggtccatcaagttcagccggcagtggatcgtgggacngaattcagtctcaccatcagcagcctgcagcctgacgattttgctaaacttactaactggcccaaagtgacaataataatcaatttcgggcggtaagggaccaaagggtggaagatacgaaaacgaactaggttggcttcggaacactaatctggttcttcttaacttcccg

SEQ ID NO: 400280 - DNA, 529 bp, Homo sapiens
  misc_feature: GZ8MTXP01BIRRP.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtccatcaaggttcagccggcagtggatcgtaggggacaagaattcagtctcaccatcagcagcctagcagccctgactattttgctaacttactactgggacctaagtgacaataataatctagtttcgggacggtaagggaccgtaaagggtggaagagtacaaacgaactggaggcttgcaccaattctgttcttcaatttccccg

SEQ ID NO: 400281 - DNA, 589 bp, Homo sapiens
  misc_feature: GZ8MTXP01BKJ6Y.15.28.C06.1.454.CMB.2.raw
  modified_base (335)..(335): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacaggaaacacccaaaagtcctgatctctcgccgcctctactttgacaaagtgggtccatcaaggttcagccggnagtgatcgtagggacaagattcagtctacacatcagcagcctgcagcctgtacgtattttgactaaacttactacgtacggacctaaggtactactaaattaaattaactacttaaacggtttcggggaaccggggtaacgggtaacccgaaagggggttcggaaagttaacgttaaaccgaaaacggtaaaccgtggttacgggcttaggaacctaacctaagttcctacgttaccttcttaacgtttccccg

SEQ ID NO: 400282 - DNA, 532 bp, Homo sapiens
  misc_feature: GZ8MTXP01A14XA.15.28.C06.1.454.CMB.2.raw
  modified_base (523)..(523): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggttggctggttcagcagaacaggaaacgacccaaaagtcctgatctctgccgcctctactttgcaaagtcgggtccatcgaaggttcagccggcagtggatcgtagggacaaggaattcagtctcaccatcagcagcctgcagtccgtgacgtatttcgctaaacttactactggacctaagtgactaataatatcgtagtttcgggcggtaacgggaccgaagggtgaagataacgaaagaactggacggcttcggaaccacaacttcgtgttacttccngtttccccg

SEQ ID NO: 400283 - DNA, 636 bp, Homo sapiens
  misc_feature: GZ8MTXP01A275L.15.28.C06.1.454.CMB.2.raw
  modified_base (364)..(364): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtggggggaggcctcgtccgaggccgggggggtccctggagactctcctgtgaagcctctggattcaccttgagcacttattggatgacttgggtccgccaggctccgagggggaaggggctgggagtgggtggccaccataacaaaaagntggaaagtgaacacaaacctatgtagaactctgtgatggggccattccacccgtctccctcacgccctcccaaccgaacggggccccagttcccggtcccttccccccgtgggccccgccccgtcgcctcccgacgggacgcccaacccgtccggaagcgtccaaccgcggcccgggccccgtggggcctcggcccgtggggtaccaaacggggttccttacccgttccccggcgttaaccggtaggaccgttggaacgggcggggtaaccg

SEQ ID NO: 400284 - DNA, 605 bp, Homo sapiens
  misc_feature: GZ8MTXP01AUSHP.15.28.C06.1.454.CMB.2.raw
  modified_base (438)..(438): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgatctctgccgcctctactttgactaaaggtggggtaccatcaaggttcagccggcaggtggatcgtagggacaagtaattcagtctcacatcagcagcctgcagtccctgacgtattttcgacctaaacttactactgggacctaaggtnactaataactaatcgtagtttcggggacgggtaacggggaaccgaaggggttaacgggaaagttacgttaaaccgaaaacggtaaccgttagggttacgggttacgttccgggaacccgtaacccgtaattccgttacggtttcctttccgttaacgttttcccccg

SEQ ID NO: 400285 - DNA, 624 bp, Homo sapiens
  misc_feature: GZ8MTXP01B75G3.15.28.C06.1.454.CMB.2.raw
  modified_base (201)..(201): a, c, t, g, unknown or other
tcagtctacgtagccacgaccggtgctcgatttagagctcacgtattgggtttgggggagtcagactcagtcaggacacagcatggacatgagggtccccgctcagctccgtggggctcctgctgctctggctcccaggtgccaaatgtgacatccagatcgacccagtcctccgtccaccctgtctgcatctggtcgganacagagtcaccatcacgttcggccgggcagtcagtagtattactaagtggttggccttggttcagacaagaaaccgagggaaacacccgaaaagtcctagatctctcgccgtccttcttactttcgacgtaaagggttcggggtacccagtacgtaaggttcaggccggacaggtcggatcggtaagggaacaaggtactttcacgtctacaccatcgagcacgcctgccacgtcctacggacgttatttacgacttaacttactacgttcgggaactaaggtcactaaattaaactaacttacgtacggtttcgggacgggtaacgggaaccgtaagggtaacggagaactaacgaaacgtaacgtgggttacggcttacggaaccacgtaacttcgttcgttcttccgttaactttccccg

SEQ ID NO: 400286 - DNA, 529 bp, Homo sapiens
  misc_feature: GZ8MTXP01ARENH.15.28.C06.1.454.CMB.2.raw
  modified_base (267)..(267): a, c, t, g, unknown or other
  modified_base (279)..(279): a, c, t, g, unknown or other
  modified_base (335)..(335): a, c, t, g, unknown or other
  modified_base (449)..(449): a, c, t, g, unknown or other
  modified_base (474)..(474): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatattactaaatggtggctgttcagcagaacagggaaancccaaaagtccngatctctcgccgcctctactttgctaaagtcgggtacccatcaaggttcagccggnagtggatcgtagggacaagtattcagttcctcaccatcagcagcctgcagcctgacgttatttgactaacttactactggacctaaaggtcactaataaatatctaagttcggngggtaaggaccgaagggtgagttanacgaaaacgactggttggcttaggccactgtactcgttcttccgaacgtttcccc

SEQ ID NO: 400287 - DNA, 509 bp, Homo sapiens
  misc_feature: GZ8MTXP01CY6P2.15.28.C06.1.454.CMB.2.raw
  modified_base (494)..(494): a, c, t, g, unknown or other
  modified_base (499)..(509): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggagggctggagtgggtggccaccatacaaaaagatggaagtgacacaacctatgtgaactctgtgatgggccgattcaccgtctccagagacgacgccaaagaactcactacatctgcaaatgaacaacctgagagccgaggacacggctgtgtattactgtgtgagagatgttctgcggttgggggccaggggaaccctggtcaccgtctcctcagcctccaccaagggccccatccggtccttccccctgggccgcccctgctcccaggagccacctccgagagcacagcacgccctgggctgccgtggtcaaggcctacttccgctacgtagactgagcgggctgggcaggccgntaagnnnnnnnnnnn

SEQ ID NO: 400288 - DNA, 547 bp, Homo sapiens
  misc_feature: GZ8MTXP01DKJ2B.15.28.C06.1.454.CMB.2.raw
  modified_base (350)..(350): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaacaggaaagccccaaaagtcctgatctctgccgcctctactttgcaaagtgggtccatcaaggttcagcggcagtggatctagggacngaattcagtctcacatcagcagcctgcagcctagacgtattttgctaaacttactactgggacctaaagtgactaataaataagtactagtttcgggacgggaacgggaccgaaagggtaaggaagaattacgaaaacgtaaacgtggttacgggcttcggcctaccaacttctagttcctttcgttaactttcccg

SEQ ID NO: 400289 - DNA, 539 bp, Homo sapiens
  misc_feature: GZ8MTXP01AJF55.15.28.C06.1.454.CMB.2.raw
  modified_base (428)..(428): a, c, t, g, unknown or other
  modified_base (478)..(478): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacagggaaagccccaaaagtcctgatctctcgccgcctctactttgacaaaggtcgggtccatcaaggttcagccggcaggtgatgtagggacaagatcagtctcacatcagcagctgccagcctgaccgtattttcgactaaacttactactggacctaagtnactaataataacgtctagttcgggacggaagggtaccgaagggtgggaanatacgaaacggtaacgtggttacggcttcgccactaacttcgtgttcttcgaacgtttccc

SEQ ID NO: 400290 - DNA, 521 bp, Homo sapiens
  misc_feature: GZ8MTXP01B5OS3.15.28.C06.1.454.CMB.2.raw
  modified_base (382)..(382): a, c, t, g, unknown or other
  modified_base (387)..(387): a, c, t, g, unknown or other
  modified_base (509)..(509): a, c, t, g, unknown or other
  modified_base (511)..(521): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaaggggctggagtgggtggccaccataacaaaaaagatggaagtgacacaacctatgtgaactctgtgatgggccgattcaccgtctccagagacgacgccaaagaactcactacatctgcaaatgaacaactgagagccgaggacacggctgtgtattactgtgtgagagatgttctggcgttgggggccagggaccctggtcacgtctcctcacgcctccacacggcccatcggtcctccccnggccnccctgctccagcgcacctcgagagcacagcacgccccgtggggctcgccgtggtacaaacggtacctaccgttcccgcgtacgtagactggacgcggggctgggaccgaagggcacgatagngnnnnnnnnnnn

SEQ ID NO: 400291 - DNA, 620 bp, Homo sapiens
  misc_feature: GZ8MTXP01CKYDQ.15.28.C06.1.454.CMB.2.raw
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaaatggttggctggttcagcagaaaccagggaaacgaccccaaaagtcctgatctctcgcccgccttcttactttcgacgtaaaacgggttcgggggtaccccagttacaaagggtttcaaggccccggactaggttgggaagttccgtaagggggaaccaaggaaactttccgaaggttcctaccaacccatccagcaaggcctgccagccctaggtacgtatttttcgacctaaacctttacttacgttacgggaccctaaagttgacctaattaaactaagtacgtagttttccggggacgggtaacgggacccgaagggtaaggagaatacgaaacgaacgtgttaggcttgcacctaatctcgttctcgttaacgttcccg

SEQ ID NO: 400292 - DNA, 568 bp, Homo sapiens
  misc_feature: GZ8MTXP01CEDBU.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagatattactaaatggttggctggttcagcagaacaggaaacacccaaaagtcctgatctctcgccgccttctactttgactaaaggtcggggtccagtcaaggttcaggccggcaggtggatcgtagggacaagaattcagtctacacatcagcagcctgcacgcctagacgtatttgactaacttactactgacctaagttgactaataactaatcgttacgttcgggagggaacgggaaccgtaagggtaaggaagttaacgtaacgaaacgtaaacgttggttagggccttacggcctaacctaattccgttgttaccttccgttaacgtttcccc

SEQ ID NO: 400293 - DNA, 626 bp, Homo sapiens
  misc_feature: GZ8MTXP01A5XGT.15.28.C06.1.454.CMB.2.raw
  modified_base (198)..(198): a, c, t, g, unknown or other
  modified_base (252)..(252): a, c, t, g, unknown or other
  modified_base (255)..(255): a, c, t, g, unknown or other
  modified_base (266)..(266): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgcagggccagtcagagtatactaatggtgctggttnagnagaacaggaancccaaaagtcctgatctctgcccgcctctactttgactaaaggtcggggtacccagtcaaggttcacggcggcagtggatcgtagggaacaggtaattcagtctacaccatcagcagcctgcaggcctgtacgtatttcgactaactttactacgtacgtaccgtaaaggttcgaacctaaattaaacttaaacttacgtaaacggttttaccgggggaacgggttaacgggggaaacccgtaaagggggttaacggaaaacgttaaccgaaaacggtaaccgttaggttacggggttccttagggtaaccccaacgtaacgttccttacggttccctttaaccgttaacgtttcccccg

SEQ ID NO: 400294 - DNA, 504 bp, Homo sapiens
  misc_feature: GZ8MTXP01C6AR0.15.28.C06.1.454.CMB.2.raw
  modified_base (345)..(345): a, c, t, g, unknown or other
  modified_base (498)..(498): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagatatactaaatggtgctggttcagcagaacaggaaagaccccaaaagtcctgatctctgccgcctctactttgcaaagtcggggccatcaagttcagccggcagtggatcgtagggacngattcagtctcacatcagcagcctgcagcctgacgtatttgactaacttactactgaccaaagtgactaataaataatctaagtttcgggacggtagggaccaagggtaagagatacaaagaactggttagcttgcacctaatctgttcttcntttccc

SEQ ID NO: 400295 - DNA, 604 bp, Homo sapiens
  misc_feature: GZ8MTXP01EIVV5.15.28.C06.1.454.CMB.2.raw
  modified_base (365)..(365): a, c, t, g, unknown or other
  modified_base (427)..(427): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacaggaaagcccaaaagtcctgatctctgccgcctctactttgcaaagtgggtccatcaaggtcagcgcagtgatctagggacaagaatcagtctcacatcancagcctgcagccctgtactagttttgacctaaactttactacttcggggaccctaaaggttnaacctaattaaattaaattactaacgttttcggggaccgggtaacgggtaacccgtaaaggggtaagggaagaaagttaaccgaaaacggtaaaccgttgggttaacggggttccttacggaaccctaaccgtaacgttccttacggttcccttttaaccgttaacgttttcccccg

SEQ ID NO: 400296 - DNA, 539 bp, Homo sapiens
  misc_feature: GZ8MTXP01ATXI8.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccaggaaacgcccaaaagtcctgatctctcgccgcctctactttgactaaaggtgggtcccatcgaaggttcagccggcagtggatcgtagggacaagaattcagtctcaccatcagcagcctgcagcctgacgtatttcgactaacttactactggaccaagtgactaataaataatctaagtttcgggacgggaggaaccgaaggggtaagaagttactacgaaacgtaacgtgttaggcttgaacaccaattctgttccttcaacttccc

SEQ ID NO: 400297 - DNA, 720 bp, Homo sapiens
  misc_feature: GZ8MTXP01AS578.15.28.C06.1.454.CMB.2.raw
  modified_base (252)..(252): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcaggtatataatagtggtcgtcgttgtnagacgaacgaacggaaacggaaccaaccgtaacgtctagtactcctcgccgtcccgtccttacttacgtacgaacgtacgggttccggtacctagtaacgtacgtacgacggcccggtagtaggtaggtacgtacgggtaaacggaactaaggttaccttacgtaccgttacccaaccctaacctacgtaaccgacgtaccgaccggtaccgcgaaccgtaccggttaccgtaaggttaacttttacgttaccaaaccctttaacttacgtacgtaccggaaacgttagtactaaacttaaattaaacttacgtacgtttaaccgggggtacgggaacgggggtaaaccgtaagggtaaagggtaacggaaattaaccgaaaacggttaaacggttggtcgggttacgttcgttaccgaacctaaccgttgtttccgttaccgttaccttcgttaacccgtttccccg

SEQ ID NO: 400298 - DNA, 658 bp, Homo sapiens
  misc_feature: GZ8MTXP01BUXDY.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgctggttcagacaagaaaccgagggaaacgacccaaaagtcctagactctctcgccgtcctcttactttgacgtaaaggtcgggtacccagtacgaaggttcaggccggcgaggtggactcgtaagggaactaaggtaattcgagtcctacgaccatcagcagcctgacagcctagtacgtatttacgactaacttactactacggactaaggtcactaaattaaacttaacgtacgttaacggtttaccggggaacggggtaacgggtaaccgtaaaggggtaacggtaaacggttaacgttaaaccggaaaacggttaaacggttcggttacggggttccttacgggaacccgtaaacccgttaatttacccgttacggtttaccctttaaccgttaacccttttcccccgg

SEQ ID NO: 400299 - DNA, 583 bp, Homo sapiens
  misc_feature: GZ8MTXP01DFOVD.15.28.C06.1.454.CMB.2.raw
  modified_base (362)..(362): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctcgccgcctcttactttgcaaagtcggggtcccatcaaggttcagccggcagtggatctagggacngaattcagtctacacatcagcagcctgcagcctgacgtatttgactaaacttactactgggtacccaagttcgactaaataaataattcgtaaagtttccgggggacgggtaacggggaccgtaaaggggttaaggaagttaacttaacgaaaacgtaaacgttggttacgggcttacggaaccacctaagttctggttcctttaaccgaacgtttccccg

SEQ ID NO: 400300 - DNA, 511 bp, Homo sapiens
  misc_feature: GZ8MTXP01DMV2M.15.28.C06.1.454.CMB.2.raw
  modified_base (254)..(254): a, c, t, g, unknown or other
  modified_base (354)..(354): a, c, t, g, unknown or other
  modified_base (446)..(446): a, c, t, g, unknown or other
  modified_base (494)..(494): a, c, t, g, unknown or other
  modified_base (506)..(506): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggttgctggttcagnagaacaggaaagcccaaaagtcctgatctctcgccgcctctactttgactaaaggtcggggtcccagtcaaggttcagccggcagtggatcgtagggacngaattcagtctacacatcagcagcctgcagcctgactatttgactaacttactactggacctaagtgacaataaactaatctagtttcgggnggtagggaccaagggtggagatacaaagtactgttaggcttagcactntctgttacttcnttccc

SEQ ID NO: 400301 - DNA, 603 bp, Homo sapiens
  misc_feature: GZ8MTXP01D9X9U.15.28.C06.1.454.CMB.2.raw
  modified_base (473)..(473): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggctggttcagcagaaacaggaaacgacccaaagtcctgatctctcgcccgtccttacttactttcgacgtaaacggttcgggggtaccccagttacgtaaagggttcacggcccggtaccgtaaggtcgggacttcggtaaggggaacaaggtaaattcacgttctacaccatcagcagcctgcagtcctgacgttatttcgactaacttactactggacctaagtnactaataatatcgtacgttcgggacggtaacgggacgaagggtaagaagttactaacgaaaacggtacgttggttcggcttacggaacctacgtaactttccgtagttaccttccgttaacgtttccccg

SEQ ID NO: 400302 - DNA, 602 bp, Homo sapiens
  misc_feature: GZ8MTXP01ENI36.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaacaggaaacgcccaaaagtcctgatctctcgccgtcctctactttgacaaagtgggtcccatcaagttcagccggcagtggatcgtaagggacaagatcagtctacaccataagcagcctgcagcctagacgtatttgactaacttactacttgaccaagtgactaataataatccgtaagtttacggggacggtaacgggaaccgtaaaggggtgggaaacgtaacgttaaacgaaaacggttaaaccgttgggttacgggaccgttcgggaccctaacccgtaatttaacccgtttcggtttacccgtttacctaaccgttttccccttttaaccccccggg

SEQ ID NO: 400303 - DNA, 559 bp, Homo sapiens
  misc_feature: GZ8MTXP01DNR7Q.15.28.C06.1.454.CMB.2.raw
  modified_base (268)..(268): a, c, t, g, unknown or other
  modified_base (279)..(279): a, c, t, g, unknown or other
  modified_base (438)..(438): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaagtggtgctggttcagcagaacaggaaacncccaaagtccngatctctcgccgcctctactttgacgtaaaggtgggtaccatcaaggttcaggccgcagtgatcgtagggacaagtattcagtcctacacatcagcagcctgcagtcccgtagtacgttattttacgactaactttactacgtcgggtacctaaggttnactaataaataacttcgtaaaggtttcgggacgggtaagggaccgaaagggtggaagttacgtaacgaaacggtacgtggttcggcttggcaactgtctcttccttaacgctttaaccccg

SEQ ID NO: 400304 - DNA, 520 bp, Homo sapiens
  misc_feature: GZ8MTXP01DBM7S.15.28.C06.1.454.CMB.2.raw
  modified_base (269)..(269): a, c, t, g, unknown or other
  modified_base (293)..(293): a, c, t, g, unknown or other
  modified_base (352)..(352): a, c, t, g, unknown or other
  modified_base (417)..(417): a, c, t, g, unknown or other
  modified_base (442)..(442): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacagggaaanacccaaaagtcctgatctctgccnctctactttgacaaaggtgggtcccatcaaggttcagccggcagtggatcgtagggacngaattcagtctacacatcagcagcctgcagctgacgtatttgactaacttacactggaccaagtnacaattaataatctaagtttcgggnggaacgggacgaaggtggagatacgaaacgtaacgttgttagggcttcggcaactcttctgttctttcaagtttcccg

SEQ ID NO: 400305 - DNA, 521 bp, Homo sapiens
  misc_feature: GZ8MTXP01CW656.15.28.C06.1.454.CMB.2.raw
  modified_base (350)..(350): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtgctgttcagcagaacaggaaacacccaaaagtcctagatctctcgccgtcctctactttgacaaagtcgggtccatcaaggttcagccgcagtgatcgtaagggacngtaattcagtctacacatcagcagcctgcagcctagacgtatttcgactaacttactactggacctaagtgacaattaataatcaagtttcgggacggacggacgaaggtggaagactaacaaacggtaaatgttcggcttagcacctaatctgttcttcaacgtttcccg

SEQ ID NO: 400306 - DNA, 576 bp, Homo sapiens
  misc_feature: GZ8MTXP01DL784.15.28.C06.1.454.CMB.2.raw
  modified_base (449)..(449): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggtggctggttcagcaagaaacaggaaacgacccaaaagtcctgatctctcgcccgcctacttactttcgacgtaaaggtcggggtacccagttcgaaaggttcacggccggcagtggatcgtagggacaagaattcagtctacacatcagcagcctgcagcctagtacgtatttcgactaaacttactactagggacctaaaggttnactaaataaattaactcgtaacggtttcgggacgggaacgggaaccgaaggggtaagaacggaataacgaaaacgtacgtgttcggcttaggccacctaattctcgttcttccgttaactttccccg

SEQ ID NO: 400307 - DNA, 522 bp, Homo sapiens
  misc_feature: GZ8MTXP01B5NRT.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagttgacccagtctccgtccaccctgtctgcatctgtcggagacagagtcaccatcacttgccgggccagtcagagtattactaaatggttggcctggttcagcagaaacagggaaagcccaaaagtcctgatctctgccgcctctactttgacaaagtgggggtcccatcaaaggttcagcggcagtgatctgggaacagaatcagtctcacatcagcagcctgcagcctagacgtattttgactaacttactactgaccaaagttgactaataaataaatcaagtttcgggcggtaagggaccaagggtggaagattacgaaacgacgtaggtggcttgacaacatctgtcttcaattctcccg

SEQ ID NO: 400308 - DNA, 509 bp, Homo sapiens
  misc_feature: GZ8MTXP01C9TKK.15.28.C06.1.454.CMB.2.raw
  modified_base (356)..(356): a, c, t, g, unknown or other
  modified_base (424)..(424): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtgggggtcccatcaaggttcagccggcagtggatctgggacngaattcagtctacaccatcagcagcctgcagcctgacgtatttgactaacttactactggccaaagtnacataataatctatttcggcggtagggaccaagggtgagatacaaagtaactgttggcttgcaccaatctgttcttcaagttccc

SEQ ID NO: 400309 - DNA, 600 bp, Homo sapiens
  misc_feature: GZ8MTXP01DHRD5.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaacaggaaagaccccaaaagtcctgatctctgccgcctctactttgactaaaggtcgggggtcccatcgaaaggttcagcccggcagtggatcgtagggacaaggaaattcgaagtctacacatcagcagcctgcagcctagacgtatttcactaaactactaacttcgggacctaaaggttcactaattaaagtaaactcgtaaagttttccgggacgggtaaacggggaacccgaaaggggttaagggaaagacgttaaaccgaaaaccggtaaacgtggttagggttacttcggaaccctaaacccttcgttcgtcgttaccttccttaacgttcccg

SEQ ID NO: 400310 - DNA, 531 bp, Homo sapiens
  misc_feature: GZ8MTXP01BAOFL.15.28.C06.1.454.CMB.2.raw
  modified_base (499)..(499): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgacgggccagtcagagtattactaaatggttggcctggttcagcagaaaccagggaaagaccccaaaagtcctgatctctgccgcctctactttgactaaaggtggggtcccatcaaggttcagccggcagtggatcgtagggacaagaattcagtctcaccatcagcagcctgcagcctgacgtattttgactaaacttactactgggaccctaaagtcgactaataataactctagtttcgggacggaagggtaccaagggtggaagatacaaagtactgngcttgaacaccaatctgttcttcaacgttccc

SEQ ID NO: 400311 - DNA, 548 bp, Homo sapiens
  misc_feature: GZ8MTXP01C4TTB.15.28.C06.1.454.CMB.2.raw
  modified_base (392)..(392): a, c, t, g, unknown or other
  modified_base (435)..(435): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtggctggttcagcagaaacaggaaacacccaaaagtcctgatctctcgccgcctctactttgactaaaggtcgggggtacccatcgaaaggttcaaggccggcaggtggatcgtagggacaagaattcagtctacacatccagcagccngcagccctgacgtatttcgactaacttacatcggactaagtanataataataatacgtacgtacggtacggacggaacgaaggtaaggaagaacgtaacgaaacgtaaacgtacggttcggcgacgaacactaactctcgttacttcgttcgtccg

SEQ ID NO: 400312 - DNA, 541 bp, Homo sapiens
  misc_feature: GZ8MTXP01DO2BD.15.28.C06.1.454.CMB.2.raw
  modified_base (411)..(411): a, c, t, g, unknown or other
  modified_base (516)..(516): a, c, t, g, unknown or other
  modified_base (526)..(526): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctggttcagcagaaacagggaaagaccccaaaagtcctgatctctgccgcctctactttgactaaaggtcgggggtcccatccgaaaggttcagccggcagtggatcgtaggggacaaggaattcgaagtctcaccatcagcagcctgcagctgacgtatttntactaacttactactcgggacctaagttagactaataaataatactagttacggtcgggacgggaccgaaggtaaggagagtacgaaacgtaagtagttgcgttncacaactctnttctcttaacttccc

SEQ ID NO: 400313 - DNA, 696 bp, Homo sapiens
  misc_feature: GZ8MTXP01EQOM2.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagtagtatactaaatggtgctgttcagcaagaaacgaggaaacacccaaaagtcctagatctctcgccgtcctcttactttgacgtaaacggttcgggggtaccctagttaccgtaaaggttcaacggtcccggacgtaggtggtaacgttccggtaaggggaacctaaggtaaactttcgaacgttccctaccaacctactccaaggccaacggccctaggaccacgtacccgttaggtaaccgtttactttttaccgaaacttaaacctttactaaccgtacggtaaaccgttaaggtacctaaacttaaattaaacttaacgttacgttaacgggtttaccggggtaaacgggtaaccgggaaacggtaagggaagtaaacgttaaacgtaaacgaaaccgtaggttcggacggttcttaccggaacctacgttaacgttcgttcttactaaccgtttccgttccccg

SEQ ID NO: 400314 - DNA, 595 bp, Homo sapiens
  misc_feature: GZ8MTXP01C9166.15.28.C06.1.454.CMB.2.raw
  modified_base (362)..(362): a, c, t, g, unknown or other
  modified_base (372)..(372): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcactgccggcagtcagagtattactaaagtggttggcctggttcagcagaaacaggaaacgacccaaaagtcctgatctctcgccgcctctactttgactaaaggttcggggacccatacgaaggttcagccggcagtggatcgtagggacngaatcagtcncacatcagcacgctgcacgcctgacgttatttagactaacttaacctactacggtacccgtaaagtcgactaaagttaaacttaacgtcgttaacggtttccggggaacgggtaacgggaaccgtaaggggttaacggaagttaacgtaaacgaaaacgtaacgtggttacggcttacggtaaccaactaacttcttcggttccttaaccgaacgtttccccg

SEQ ID NO: 400315 - DNA, 574 bp, Homo sapiens
  misc_feature: GZ8MTXP01DOIMU.15.28.C06.1.454.CMB.2.raw
  modified_base (443)..(443): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccggcagtcagatattactaaatggtgctggttcagcagaacaggaaacacccaaagtcctagatctctcgccgccttacttactttgacgtaaagggtcggggtaccccagttacgaaggttcaggcccggactaggtggatcgtaagggaacaaggtaattcaagtctacacatcagcacgctgcacgcctagtacgtatttgactaacttactactgactaagtnacaataaatatcgtagttcgggacggaagggaccaaagggtcggaagaactaaacgaaaacggtaaacgttggttacgggcttacggaacctaaccgtaagttcctgttaccttaacttaacgtttccccg

SEQ ID NO: 400316 - DNA, 571 bp, Homo sapiens
  misc_feature: GZ8MTXP01EGSJW.15.28.C06.1.454.CMB.2.raw
  modified_base (270)..(270): a, c, t, g, unknown or other
  modified_base (397)..(397): a, c, t, g, unknown or other
  modified_base (425)..(425): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtccaccatcacttgccggcagtcagagtattactaaatggttgctggttcagcagaacaggaaacncccaaaagtcctgatctctgccgcctctactttgactaaaggtgggtacccatcaaggttcagccggcagtggatcgtagggacaagaatcgagtctacaccatcagcagcctgcagcctagacgtntttcactaacttactactggacaaggtnactaataatatctaagtttcgggacggggtaacggaaccgtaaaggggtggaaagacgttaaacgaaaaccggtaaacgttgggttcgggcttacgggtaaccaccctaagtttcgtacgttccttaaccgttaacgtttcccccg

SEQ ID NO: 400317 - DNA, 602 bp, Homo sapiens
  misc_feature: GZ8MTXP01EHUZY.15.28.C06.1.454.CMB.2.raw
  modified_base (198)..(198): a, c, t, g, unknown or other
  modified_base (353)..(353): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagatatactaaatggtgctgttcagcagaacaggaaacgacccaaaagtcctgatctctcgccgtcctcttacttgacgaaaggtcgggtccatcgaaggttcagccggcagtggatcgtagggacngtaatcagtctacacatcagcagcctgcgacgtcctagtacgttatttcgactaaactttactacgttcggactaaaggtcaactaaattaaattaacttacgtaacgttttccggggaacgggtaacggggtaaccgtaaaggggttaacgggaaagttaaacgtaaaccgttaaaacggtaaccgttggttacgggttcttacggaacctaacctcttactcgttacctttccgttaactttccccg

SEQ ID NO: 400318 - DNA, 584 bp, Homo sapiens
  misc_feature: GZ8MTXP01A9N9T.15.28.C06.1.454.CMB.2.raw
  modified_base (556)..(556): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaccagggaaacacccaaaagtcctgatctctcgccgcctcttactttgactaaaggtcgggggtacccatcgaaggttcagcccggcaggtggatcgtagggaacaaggtaattcgagtctacaccgatcagcagcctgcagcctgacgtatttacgactaacttactactcggacctaaggttcactaataattaactcgtaagtttcgggacggggtaagggtaccgtaaaggggtcggtaagaacgtaccgaaaacggtaaccgtggttacgggcttacggaacctacgtnttacgtgttaccttcgttaacttccccg

SEQ ID NO: 400319 - DNA, 552 bp, Homo sapiens
  misc_feature: GZ8MTXP01C1ZT2.15.28.C06.1.454.CMB.2.raw
  modified_base (356)..(356): a, c, t, g, unknown or other
  modified_base (529)..(529): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaacgccccaaaagtcctagatctctgccgcctctactttgcaaagtgggtcccatcaaggttcagccggcagtggatcgtgggacngaaattcagtctacacatcagcagcctgcacgctgacgtatttgactaacttactaacgttgaccaaaggttcactaattaaactaattctagtttcgggacgggaaggggacctaaagggtcggaaggattacgaaacggtaaacgtgttacgggcttaggcctaacccgtnttctcgttaccttcgcgttcccg

SEQ ID NO: 400320 - DNA, 538 bp, Homo sapiens
  misc_feature: GZ8MTXP01BMQ1U.15.28.C06.1.454.CMB.2.raw
  modified_base (425)..(425): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaacaggaaagacccaaaagtcctgatctctgccgcctctactttgacaaagtgggtccatcaaggttcagccgcagtggatcgtagggacaagaatcagtctcaccatcacgcacgctggcagtccctagacgtatttcgactaacttactactcgggactaagtnactaataaactaatctaagtttcgggagggtaagggaccgaaagggtggaagagtacaaaacgtacgtgttaggcttcggccactaacttctgttcctttcgaagtttccccg

SEQ ID NO: 400321 - DNA, 557 bp, Homo sapiens
  misc_feature: GZ8MTXP01CGUZ6.15.28.C06.1.454.CMB.2.raw
  modified_base (273)..(273): a, c, t, g, unknown or other
  modified_base (296)..(296): a, c, t, g, unknown or other
  modified_base (367)..(367): a, c, t, g, unknown or other
  modified_base (372)..(373): a, c, t, g, unknown or other
  modified_base (375)..(375): a, c, t, g, unknown or other
  modified_base (381)..(381): a, c, t, g, unknown or other
  modified_base (383)..(383): a, c, t, g, unknown or other
  modified_base (385)..(385): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaaccatcacttgccgggcagtcagagtattactaaatggttggctggttcagcagaaaccagggaaanacccaaaagcctgatctctgccnctctactttgacaaaggtgggtaccatacaaggttcagccggctagtggatcgagggacaagaatcatctnaccannancacgcncncncgactacgtacgtattacgtactaacttactactacgacgtaagtagacaataaataatacgttacgtacggtacggaacgggaacggaagggtaaggaagaagtaaacgaaacgtaaacgtagttcggcgttacgaacacctaactactacgttacttaacttaacgtccg

SEQ ID NO: 400322 - DNA, 516 bp, Homo sapiens
  misc_feature: GZ8MTXP01DSYKH.15.28.C06.1.454.CMB.2.raw
  modified_base (348)..(348): a, c, t, g, unknown or other
  modified_base (413)..(413): a, c, t, g, unknown or other
  modified_base (480)..(480): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtatactaaatggtgctggttcagcagaacaggaaagcccaaaagtcctagatctctcgccgccttctactttgacaaagtggggtccatcaaggttcagcggcagtgatcgtagggacngattcagtctcaccatcagcagctgcagcctgacgtatttgactaacttactactagaccaagtnacaataataattctaagtttcggacgggtagggaccgaagggtaaggaagatacgaaacgaacgtgnggcttagcactaatctgttcttcgttaaactttccc

SEQ ID NO: 400323 - DNA, 632 bp, Homo sapiens
  misc_feature: GZ8MTXP01D4SIG.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagacgtcaccatccacgttcggccggcagtcagtagttattaactaagtggttgccttggttcagacaagaaaccgagggaaacgacccgaaagtcctagatcctcgtcgccgtccttacttacgtttgacgtaacggtcgggtacctagtacgtaaggtcgagcggcgtaggtgtatcgtaagggacaagtattcacgtctacacatcacgacacggtcctggccagtcctagtacgttatttacgacctaacttactaccgtaggaacctaagtacgactaaattaaattaactcgttaaggttcgggacgggtaacgggaacgtaagggtaacggaagttaacgtaaccgttaaaacggtacgttggcggttcttaccggaacctaaacccgttcttacgtccgttaccttaaccgttccgttccccg

SEQ ID NO: 400324 - DNA, 534 bp, Homo sapiens
  misc_feature: GZ8MTXP01C66JE.15.28.C06.1.454.CMB.2.raw
  modified_base (441)..(441): a, c, t, g, unknown or other
  modified_base (497)..(497): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagttgacccagtctccgtccaccctgtctgcatctgtcggagacagagtcaccatcacttgccggccagtcagagtattactaaatggttggctggttcagcagaaacagggaaacgacccaaaagtcctagatctctcgccgcctctactttgacaaaggtcgggtcccatcaagttcagcgcagtgatcgtggaacagaatcagtctacacatcagcagcctgcagcctagtacgtattttcgactaacttactactcgaccgtaagtgacaattaataactntagtttcgggacggtaagggaccgaaggggtggaagaacttacgaaacgacgttgngttcgttgccaacatctgtcttctaacttccttcccg

SEQ ID NO: 400325 - DNA, 532 bp, Homo sapiens
  misc_feature: GZ8MTXP01EQNPS.15.28.C06.1.454.CMB.2.raw
  modified_base (359)..(359): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctcgccgcctctactttgcaaagtgggtccatcaaggttcagccggcagtggatcgtagggacngaaattcagtctcaccatcagcagcctgcagcctgacgtatttgactaaacttactactggacctaaagtgacaataaatatactagtttcgggcggtaagggaccaaaggggtggaagaataacgaaagtaacgtggttaggcttgccactaatctgttcttcttaattccc

SEQ ID NO: 400326 - DNA, 526 bp, Homo sapiens
  misc_feature: GZ8MTXP01D519S.15.28.C06.1.454.CMB.2.raw
  modified_base (267)..(267): a, c, t, g, unknown or other
  modified_base (509)..(509): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaacaggaaacncccagaagtcctgatctctcgcccgtcctctactttgacgtaaagtcgggtccatcgaagtcacgcggcagtgatcgtagggaacagtaattcgagtctacacatcagcagcctgcacgcctagacgtatttgactaacttctacgtgacctaaagtcgactaattaaataatctagtttcgggacggtaacggacgaaggtgaagacttacgaaacgtacttggcgctcgactaactagtnttacgtcctttcgaacc

SEQ ID NO: 400327 - DNA, 530 bp, Homo sapiens
  misc_feature: GZ8MTXP01CT8ZY.15.28.C06.1.454.CMB.2.raw
  modified_base (357)..(357): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgacccaaaagtcctgatctctgccgcctctactttgcaaagtgggggtccatcaaggttcagccggcagtggatcgtgggacngaattcagtctcaccatcagcagcctgcagcctgacgtattttgctaaacttactaccttgggacccaaagttcgactaataaactaaatcaaagtttcgggcggaaggggaccaaagggtggaagatacgaaagaaactgttaggcttgcaccaatctgttctcgaattccc

SEQ ID NO: 400328 - DNA, 529 bp, Homo sapiens
  misc_feature: GZ8MTXP01CPOCK.15.28.C06.1.454.CMB.2.raw
  modified_base (354)..(354): a, c, t, g, unknown or other
  modified_base (513)..(513): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagatattactaaatggtgctgttcagcagaacagggaaacacccaaaagtcctagatctctcgccgcctctactttgactaaaggtcgggtacccatacgaaggttcagccggcagtgatcgtagggacngaattcagtctcacatcagcagcctgcagcctgacgtatttgactaacttactactggacctaagtgactaataataatctacgttcggacggaagggaaccaagggtaaggaacgataacaaacggtaactgacggcttggaaccacctgttaccttnttcctcgttcgtcccg

SEQ ID NO: 400329 - DNA, 560 bp, Homo sapiens
  misc_feature: GZ8MTXP01BSI2A.15.28.C06.1.454.CMB.2.raw
  modified_base (436)..(436): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccccgtctgcatctgtcggagacagagtcaccatcacttgccgggcagtcagagtatactaaatggttggctggttcagcagaaacagggaaacgacccaaaagtcctgatctctcgccgcctctactttgacgtaaaggtcgggtccatcgaaggttcaggcggcaggtggatcgtgggaacagtaatcagtctacacatcagcagcctggcacgcctagacgtattttcgactaacttactacgtcgacctaaggtnactaataataacgtctagtttaccggggacggtaagggaacctaaggggtcggaagtaattaacgaaaacgttaacgtggtacgcgttcggacaaccattctagtccttctaacttcctccccg

SEQ ID NO: 400330 - DNA, 568 bp, Homo sapiens
  misc_feature: GZ8MTXP01DT9WH.15.28.C06.1.454.CMB.2.raw
  modified_base (197)..(197): a, c, t, g, unknown or other
  modified_base (426)..(426): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagatatactaaatggtgctgttcagcagaacaggaaacacccaaaagtcctgatctctgccgtcctctactttgacaaagttcggggtcccatcaaggttcaggccggcaggtggatcgtagggacaaggaaattcacgtctacacatcagcagcctgcagcctgacgttatttgactaattactacgtcgacctaaagtnactaattaaataatctaacgtttcgggacgggaacgggtaccgaaagggttaaggaagttaacgtaacgaaaacgtaaacgttggttacggttcttaggcctaaacccgttgttcgttcgttctttaacgttaacgtttccg

SEQ ID NO: 400331 - DNA, 581 bp, Homo sapiens
  misc_feature: GZ8MTXP01BT57P.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagttgacccagtctccgtccaccctgtctgcatctgtcggagacagagtcaccatcacttgccgggcagtcagagtatactaaatggtgctggttcagcagaaacaggaaacgcccaaaagtcctgatctctgccgcctctactttgacaaaggtcgggtcccatcgaaggttcagcggcaggtggatcgtgggaacagaattcagtctcacatcagcagctgcagctagacgtatttcgactaacttactactgaccgtaagttgactaaattaaactaagttaccgtagtttaccggggacgggtaacggggaaccgtaaggggttgggaaagtaacttaaccggaaaacgttaacgttaggtacgggcttcggacctaacctagttccttcggttacctttacctaactttcccgttccccg

SEQ ID NO: 400332 - DNA, 588 bp, Homo sapiens
  misc_feature: GZ8MTXP01CD007.15.28.C06.1.454.CMB.2.raw
  modified_base (381)..(381): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccccgtctgcatctgtcggagacagagtcaccatcacttgccgggccagtcagagtattactaaatggttgctggttcagcagaaacaggaaacacccaaagtctgatctctcgccgctcttactttgacgtaaaggtcgggtaccatacgtaaggttcaggcggcctaggtggatcgtgggaacagaattcagtctcacatcancagcctgcagcctagacgtatttcgactaacttactactagacctaaagttcgactaaataaattaactacgttaagtttaccggggacgggaaacgggaacccgtaaggggtaggaaagtaattaacgtaaaacgacgtacggtgggttcttcggaccctaaccctattccgttagttcctttacctaacttcccgtttaaccccg

SEQ ID NO: 400333 - DNA, 531 bp, Homo sapiens
  misc_feature: GZ8MTXP01AOS31.15.28.C06.1.454.CMB.2.raw
  modified_base (287)..(287): a, c, t, g, unknown or other
  modified_base (429)..(429): a, c, t, g, unknown or other
tcagtctacgtagccacgaccggtgctcgatttagagctcacgtattgggtttgggggagtcagactcagtcgggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtccngatctctgcccgcctctactttgacaaaggtggggtcccatcaaggttcagcggccaggtggatcgtgggaacagaattcagtctcacatcagcagcctgcacgcctagacgtatttgactaacttactactgaccaaggtnacaattaaataatctagtttcgggacggtagggaccaaggggtggaaggtattacgaaacgagtgtacggcttgcaactatctgtcttctaacttccgtccc

SEQ ID NO: 400334 - DNA, 516 bp, Homo sapiens
  misc_feature: GZ8MTXP01A5XX8.15.28.C06.1.454.CMB.2.raw
  modified_base (338)..(338): a, c, t, g, unknown or other
  modified_base (353)..(353): a, c, t, g, unknown or other
  modified_base (367)..(367): a, c, t, g, unknown or other
  modified_base (372)..(372): a, c, t, g, unknown or other
  modified_base (509)..(509): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacagggaaacgacccaaaagtcctgatctctgccgcctctacttgacaagtgggtccatcaaggttcagccggnagtgatcgagggacngaatcagtctcacntacancagcctgcagcctgtacgtatttcgactaacttactactgggacctaagtgacaataatatacgtagttcggacggtaggaccgaaggtggagatacgaaacgaacgtgttaggcttacggcacaatctgttcttcncttcccg

SEQ ID NO: 400335 - DNA, 550 bp, Homo sapiens
  misc_feature: GZ8MTXP01BQAEE.15.28.C06.1.454.CMB.2.raw
  modified_base (432)..(432): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagttgacccagtctccgtccaccctgtctgcatctgtcggagacagagtcaccatcacttgccgggccagtcagagtatactaaatggtggctggttcagcagaaacagggaaacgacccaaaagtcctgatctctgccgccttctactttgcaaaggtcgggggtcccatcaaggttcagcggccaggtggatctgggaacagaattcagtctcacatcagcagcctgctagctagacgtattttcgactaaacttacacttagaccaaaggttnactaataaataatcgtaagtttcgggacgggtacgggaccgaagggtggaagtacttacgaaaaccgttaagtggtgcgttgaccaacatcttcgtcttactaacgttcctaaccccg

SEQ ID NO: 400336 - DNA, 592 bp, Homo sapiens
  misc_feature: GZ8MTXP01A0R0P.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgctggttcagcagaacaggaaacgcccaaaagtcctgatctctgccgcctctactttgacaaagtgggtcccatcaaggtcagccggcagtggatcgtagggacaagattcagtctcacatcagcagctgcagcctgtacgtattttcgactaaacttactactcggacctaagtcgactaataaactaacttcgtaagtttccggggacgggtaacggggaacccgaaaggggttaagggaaagttaacgttaaaccgaaaacggtaaaccgttggggttacggccgttacggaaccaaccccgtaagttccttcggtttaccctttccgttaaccgttttcccccg

SEQ ID NO: 400337 - DNA, 571 bp, Homo sapiens
  misc_feature: GZ8MTXP01CBABO.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctgggactcctgctgctctggctcccaggtgccaaatgtgacatccagatgacccagtctccgtccaccctgtctgcatctgtcggagacagagtcaccatcacttgccgggcagtcagagtattactaaatggtggctgttcagcagaacgaggaaacgacccaaagtcctgatctctcgccgtcctcttactttgacgtaaaggtcggggtaccagtcgtaaggttcaggccggcaggtggatcgtaagggacaagtaattcgagtctacacatcagcagcctgcagtccgtgtaacttatttacgacctaacttactactcgggactaaggtcactaataaactaatcgtaaggtttccgggacgggtacgggaacgtagggtaagaagttagtaaacgaaacggtaactggcggttcttacgaacacctaattcgtacttccttcaacgtttccccg

SEQ ID NO: 400338 - DNA, 567 bp, Homo sapiens
  misc_feature: GZ8MTXP01B9QBY.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatatactaaatggttgctggttcagcagaacaggaagacccaaagtcctgatctctcgccgcctctactttgacaaaggtcgggtccatcgaaggttcaggccggcaggtgatcgtagggacaagtaatcgagtctacacatcagcacgctgcagcctgactatttgactaacttactactcgacctaagtcactaattaataactcgtaacgtttcgggacgggtaacgggaccgtaaggtcggaagttacgtaacgaaaaccgtaaacgtgggttacgggcttacggaacctaaacccgtaattccgttcggtttcctttcgttaaccgtttccccg

SEQ ID NO: 400339 - DNA, 579 bp, Homo sapiens
  misc_feature: GZ8MTXP01A2N9Q.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgctggttcagcagaacagggaaacgacccaaagtcctagatctctcgccgcctcttactttgacaaaggtcgggtccagtcaaggttcagccggcaggtgatcgtagggacngaatcagtctacacatcagcacgcctgccagtcctgtacgtatttcgactaacttactacgtcggacctaagtcgactaataaatatacgtaagtttcggaacgggacggtaaccggaagggtaaggaagttacgtaaccgaaaacggtaacgtagggttcggttcgttacggaacctaaaccgtcttccgttcggttaccttaaccgttaaccttttccccg

SEQ ID NO: 400340 - DNA, 553 bp, Homo sapiens
  misc_feature: GZ8MTXP01DGS9Z.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggtgctggttcagcagaacaggaaacgacccaaaagtcctgatctctcgccgcctctactttgactaaaggtcggggtcccatcaaggtcagccggcagtgatcgtagggacaagaattcagtctcacatcagcagctgcagcctgacgtatttcgactaaacttactactaggaccaagtcgacaattaaataatacgtagtttcgggacgggtaaggggaccgaaaggggtggaagttaagtaacgaaaacggtaacgttggttcgggcttaggccaacgtaattcctgttacctttccgaacgtttccccg

SEQ ID NO: 400341 - DNA, 662 bp, Homo sapiens
  misc_feature: GZ8MTXP01AJOXH.15.28.C06.1.454.CMB.2.raw
  modified_base (460)..(460): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaagtggttggctggttcagcaagaaaccgagggaaacgacccaaaagtcctgatctctcgcccgccttctactttgactaaagggtgggtacccatacgaaggttcaggccgacagtggatcgtaagggacaagattcgagtcctcaccatcagcagcctgcctagccctaggtaccgttattttacggactaaactttactacgttcggacgtaaaggttnaacctaaattaaattaaacgttaccgttaaacgggttttccgggggaaccgggggtaaacggggtaacccggtaaagggggttaaccgggaagttaaacggttaaaccgaaaaacgggttaaccgtggggttacggggttacttaccggaaccgtaaccgttaacttccgttacggtttacctttccgaacttttcccccgg

SEQ ID NO: 400342 - DNA, 630 bp, Homo sapiens
  misc_feature: GZ8MTXP01EP6C6.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagtagtattactaatggtgctgttcagcagaaacgaggaaacacccaaaagtcctagatctctacgccgtcctacttactttcgacgtaaacggtcggggtaccatacgaaggttcacgtccggactaggtgatcgtaagggacaagtactcacgtctacacatcagctacggcctagcagtcctagtacgtatttacgacctaaactttactactacggggtaacctaaggtactaactaaattaaactaacgttacgttaaacggtttccggggaacggggttaacgggaacccggtaaaggggtaagggtaaacgaacgttaaccgaaaacggtaacgtgggttacgttcgttacggcctaacccgtaattctacggttcctttaacgttaacgtttccccg

SEQ ID NO: 400343 - DNA, 710 bp, Homo sapiens
  misc_feature: GZ8MTXP01D3KQS.15.28.C06.1.454.CMB.2.raw
  modified_base (199)..(199): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagatcacatcacttgccggcagtcagatatactaaatggttgctgttcagcaagaacgaggaaacacccaaagtcctagatctctcgccgtccttcttactttagacgtaaaggttcgggtacccagttacgtaacggttcgacggtcccggcgtaggtggagttacggtaagggaactaaggtaacttacgtaacgttcctacctaaccctagtaccacgtaccgacgttcccgtgaccgaacggtccccttagggtaaccgtttagtttttaccgaactttaaacctttaaccttaaccgttacgggggaacccttaaagggttcgtaacttaaattaaactttaacgttaccgttaaacggttttccgggggtaacggggttaaaccggggaaaccggtaaggggtaaggaacgttaaacgtaaacccgaaaaggtaaccgttgggttcggttcttacggaacctaaccgtcttaccgttcgttcctttaacgttccgtttccccg

SEQ ID NO: 400344 - DNA, 840 bp, Homo sapiens
  misc_feature: GZ8MTXP01C5BIS.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggccttggttcagacaagaaaccgagggaaacgaccccaaaagtcctagatctctcgcccgccttacttactttggacgtaaacgggttcgggggtacccctaagttaccgaaacgggtttcgaacggcccggggtaccgtaaaggttgggtaagttacccggttaacggggggaaaccctaagggtaaactttcccgtaaacggtttccctaccgaaacccctattacccgaacggtacccgaacggtccccgttacggacccgtaacggtaccccgtttaacgggtaaccggtttaacgtttttttccggaaaccctttaaacccttttaaaccgttaaccgtttacggggtaaccccgttaaaacggggtttacgtaaaccgttaaaagtttaaaaccttaaacgtttacgttaaaaccgggtttttccgggggtaaaccgggggtaaacggggtaaaccccggttaaaagggggtaacgggtaaacggttaagttaaacccgaaaacggtaaaccgtggggttacggttcttacgggaaccctaaaccgtctttccggttagtttcccttaacttaaccgttttcccccg

SEQ ID NO: 400345 - DNA, 852 bp, Homo sapiens
  misc_feature: GZ8MTXP01BKK1T.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggttgctggttcagcaagaaccgaggaaacgacccaaaagtcctagatctctcgcccgtcctcttactttgacgtaaacgggttcggggtaccccagttaccgtaaaggttcgaacggtccggaccgtagggttagggaacgttccggttaaacgggggaaaccctaagggtaaacttttaccgaacggttaccccttaaccgaaacccgtaacttacccgtaacggaccgaaaccggtccccgttcggacccgtaacgggtacccccgttagggttaaacccggtttattttttaccggaaacccttaaaacccgttttaaacccttaaacccgtttaccggggaaaccccgttaaaggggttaccgtaaacccgttaaaacgtttaaaatttaaaccggtttaccgtttaaacgggtttttacccgggggaaaccgggggttaaaccgggggtaaaccccggtaaagggggttaaacgggtaaaggttaaaccgttaaacccgaaaaaccggtaaaccggtttgggttaaccggggttaccttaccgggaaccctaaccccgttaagtttccccttcggtttaccctttcgtttaacccgttttcccccg

SEQ ID NO: 400346 - DNA, 513 bp, Homo sapiens
  misc_feature: GZ8MTXP01DH1YV.15.28.C06.1.454.CMB.2.raw
  modified_base (198)..(198): a, c, t, g, unknown or other
  modified_base (359)..(359): a, c, t, g, unknown or other
  modified_base (398)..(398): a, c, t, g, unknown or other
  modified_base (428)..(428): a, c, t, g, unknown or other
  modified_base (498)..(498): a, c, t, g, unknown or other
  modified_base (502)..(502): a, c, t, g, unknown or other
  modified_base (508)..(508): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtattactaaatggttggcctggttcagcagaaaccagggaaacgaccccaaaagtcctgatctctgccgcctctactttgacaaagtggggtcccatcaaggttcagccggcagtgatctagggacngaattcagtctcaccatcagcagcctgcagcctgacgtntttgactaacttactactggacccaaggtnactaataataatctaagttcggaggaggaccaagggtgagatacgaaacgtactgttggcttgcaacctntctnttctcnctccg

SEQ ID NO: 400347 - DNA, 517 bp, Homo sapiens
  misc_feature: GZ8MTXP01DZBL3.15.28.C06.1.454.CMB.2.raw
  modified_base (359)..(359): a, c, t, g, unknown or other
  modified_base (505)..(505): a, c, t, g, unknown or other
  modified_base (511)..(511): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggttcagcagaaaccagggaaacgacccaaaagtcctgatctctcgccgcctctactttgacaaaggtggggtcccatcaaggttcagccggcagtgatcgtagggacngaattcagtctcacatcagcagctgcagcctgacgtatttgactaacttactactggactaaggtcactaataaatatctaagttcggacgggtaggaccgaagggtggaagatacgaaacgaatggttaggcttgcacaatcgtnttctcnttcccg

SEQ ID NO: 400348 - DNA, 673 bp, Homo sapiens
  misc_feature: GZ8MTXP01BQZBQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggcagtcagagtattactaaatggttggctgttcagcaagaaaccgagggaaacgaccctaaaagtcctagactctccgtcgccgtctcttacttcgacgtaacgggtcgggtacctagtacgtaaggtcacggccgacgtaggtggactcggaagggaactaagtactacgtacgtcctacctaacactacgacgacgacgtccgcgacgtacgtaccgtagtacgttacttacgacttaaacgttactacgtacggaaccgtaaggtactaaccttaaattaaactacgttaccgttaacgggttacgggaaccgggggtaacgggtaaccggtaagggtaacggtaaacgttaaacgtaaaccgttaaaacgggtacgttacgggttacgggaccttacggaaccctaccgttaactaccgttcgttaccctttccgttaacctttcccccg

SEQ ID NO: 400349 - DNA, 577 bp, Homo sapiens
  misc_feature: GZ8MTXP01DLQJX.15.28.C06.1.454.CMB.2.raw
  modified_base (374)..(374): a, c, t, g, unknown or other
tcagtctacgtagccacgaccggtgctcgatttagagctcacgtattgggtttggggggagtcagctcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggtgctgttcagcagaacaggaaacaccccaaagtcctgatctctcgccgcctctactttgacaaaggttcggggtcccatcaaggttcagcggcagtggatcgtagggacaagattcagtctacacatcagcanccgtgcgacgaccctaggtaccttagttttacgacctaaactttactacctacgggaccctaaggttcactaattaaataacttcgtaacgttttcggggacgggtaacgggaaccgtaagggtaaggaagttaactaacgaaacgtaacgtggttacggcttacgctacctaattccgtgtttaccttcttaactttccccg

SEQ ID NO: 400350 - DNA, 638 bp, Homo sapiens
  misc_feature: GZ8MTXP01DC1AC.15.28.C06.1.454.CMB.2.raw
  modified_base (252)..(252): a, c, t, g, unknown or other
  modified_base (406)..(406): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacgttgccggcagtcagagtatactaatggtgctgttcanacaagaacgaggaaacacccgaaagtcctgatctctcgccgcctcttacttgacgtaaagggttcgggacctagtacgtaaggttcaggccggcgaggtggatcgtaagggaacaagtaaattcgtacgtcctacactatcgacgcacggtccngaccacgtacctggtaacttacgttttacgaccttaaacttaccgtaacgtcggggtaaccctaaggttacaacgtaaattaaacttaacgttaccgttaaggtttaccggggaccggggaaacggggtaaccgtaaagggttaagggaacttaaacgttaaacggaaaacgtacgtaggttcggcgttacgaaccaacgtcgttctacgtttcccttcaaccgtttccccg

SEQ ID NO: 400351 - DNA, 604 bp, Homo sapiens
  misc_feature: GZ8MTXP01EESDO.15.28.C06.1.454.CMB.2.raw
  modified_base (404)..(404): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccggcagtcagagtattactaaatggttgctggttcagcagaaacgaggaaacacccgaaaagtcctagatctcgtcgccgcctctactttgacgtaaaggtcggggtcccattacgaaaggttcaaggccggcgagtggatcgtagggaacaaggaaactttcacgtctacaacatacagcacgccncgacacgtacgtacgtacgtacttacgtactaactactactacgtacgtacgtacgtactaataattaacttacgtacgttacgggtacgggtaacgggtaacggtaaggtaaggtaagttaacgtaaacgttaaacgtaaacgtacggttaggttcgttacgtaactacgtaacgtcgttcgttacttcgttcgttccg

SEQ ID NO: 400352 - DNA, 557 bp, Homo sapiens
  misc_feature: GZ8MTXP01DU72B.15.28.C06.1.454.CMB.2.raw
  modified_base (349)..(349): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgctggttcagcagaacaggaaacgccccaaaagtcctgatctctgccgcctctactttgacaaaggtgggtccatcaaggttcagcgcagtgatcgtagggacngaattcagtctcacatcagcagctgcacgactcgtacgtatttcgtactaacttactactacgtacctaagtagacaataataatacgtacgttcggtacgggacgggaaccggaagggtaagggtaaggaagtacgaaacgtaaacgtaggttagggttcgttacggaacacctaacgttcgttcgttcttcgttaacgtttccccg

SEQ ID NO: 400353 - DNA, 735 bp, Homo sapiens
  misc_feature: GZ8MTXP01D0V1B.15.28.C06.1.454.CMB.2.raw
  modified_base (277)..(277): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagatcacatcacttgccggcagtcagtagtattactaatggtgctgtcagcagaacaggaaacacccaaaagtccngatctctcgccgtccttacttacgtttcgacgtaaacgggttcgggggtacccaagttcgtaaaggttcgacggtccggccgtaaggtcggtaagttcccggtaaagggggaacctaagggtaaactttaccgtaacggttacccttaccgaaccctaacgttaccgaaacgcccgtaacgggtccctcgggaccaacggttccccgttaggttaacccggtttatttttaccggaaccttaaaccgtttaacctaccgttacggggtaaccctaaaggttaccgtaaactaaattaaacgttaacttacgttaaacgttttcggggaacgggaacgggtaaccgaaaggggttaagaaacgttaaacgttaaaccgaaaacggtacgttagttcgggttcttacggtaaccaaaccgttctttcgttacgtttaccttcgttaaccgttttcccccg

SEQ ID NO: 400354 - DNA, 707 bp, Homo sapiens
  misc_feature: GZ8MTXP01EN7AP.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggtgctgttcagcagaacgaggaaacgacccaaagtcctgatctcgtcgccgtcctcttactttgacgtaaacggttcggggtacccagttacgaaggttcgacggccggcgtaggtagggtacttccggtaagggggaacctaaggtaaactttccgaacgttcctaccgaaccataccgaacgcaacggtcctaggccacggtaccccgttaggtaaccgttagttttacgaccctaaaaccgttttaccgtaaccttacggggaccctaaagggttacgaacctaaattaaacgttaaacttaccgtaaacggttttccgggggaccgggtaaacggggaacccggtaaagggggtaacggaaacgttaaacgtacggttaaaaaacgtaccgttagggttacgggttcttacggaaccctaaccgtaacttccgttacgttaccctttaacgttcctttcccccg

SEQ ID NO: 400355 - DNA, 535 bp, Homo sapiens
  misc_feature: GZ8MTXP01B0CN0.15.28.C06.1.454.CMB.2.raw
  modified_base (357)..(357): a, c, t, g, unknown or other
  modified_base (514)..(514): a, c, t, g, unknown or other
  modified_base (519)..(519): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaaccagggaaagccccaaaagtcctgatctctgccgcctctactttgcaaagtggggtcccatcaaggttcagccggcagtggatctagggacngaattcagtctcaccatcagcagcctgccagccctgtaccgtattttcgctaaaccttactactcggacctaaagtcgactaataataactctaagtttcgggacgggacgggaccgaagggtggaacgatacgaaacgtacgtgcggcttgcactntcgtnttcttcaacgttcccg

SEQ ID NO: 400356 - DNA, 517 bp, Homo sapiens
  misc_feature: GZ8MTXP01DFWQB.15.28.C06.1.454.CMB.2.raw
  modified_base (349)..(349): a, c, t, g, unknown or other
  modified_base (423)..(423): a, c, t, g, unknown or other
  modified_base (469)..(469): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgctggttcagcagaaacaggaaacgacccaaaagtcctgatctctcgccgctctactttgcaaagtcgggccatcaaggttcagccggcagtgatcgtagggacngaaattcaagtctcacatcagcagcctgcagcctagacgtattttgactaaacttactaactggaccaaaggtnacaattaataatcgtattcgggcggagggaaccaagggtcggaaanatacgaaagtacgtgttggcttgcacctaatctgttctcaacgttccc

SEQ ID NO: 400357 - DNA, 553 bp, Homo sapiens
  misc_feature: GZ8MTXP01DXO1H.15.28.C06.1.454.CMB.2.raw
  modified_base (368)..(368): a, c, t, g, unknown or other
  modified_base (438)..(438): a, c, t, g, unknown or other
  modified_base (452)..(452): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagagtattactaaatggttgctggttcagcaagaaacagggaaacgccccaaaagtcctagatctctcgccgccctacttactttgctaaaggttcgggtaccctatacaaggttcaggtccgcagtggatcgtagggacngtattcagtctacacatcagcagcctgcagcctgacgtatttcgactaacttactactgggaccaaggtnactaataatacttnaacgtttcgggacggtaaggaccgaagggtaaggagataacgaaacgtaactggttcggcttaggcctacctaattcgtagttccttcgaagttttccccg

SEQ ID NO: 400358 - DNA, 588 bp, Homo sapiens
  misc_feature: GZ8MTXP01COC56.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcacatcacttggccggcagtcagagtattacaaatggtgctggttcagcagaaacgaggaaacacccaaagtcctgatctctcgcccgccttactactttggacgtaaagggttcgggggtacccagtcgtaaaggttcaggcccggacgaggtggatcgtaaggggaacaaggtaacttcgagtcctacacctatcagcacgcctgcagcctagtacgtatttcgactaacttactacttggaccctaaggtcactaaattaaacgtatcgtaagtttcgggacgggtaacgggaaccgaagggtggaagactaccgaaacggtaacgtggttaggcttcggaactacctaatcgttagttcttaaccttcgtttaaccccg

SEQ ID NO: 400359 - DNA, 609 bp, Homo sapiens
  misc_feature: GZ8MTXP01EVLW7.15.28.C06.1.454.CMB.2.raw
  modified_base (389)..(389): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtcctgagactctcctgtgaagcctctggattcaccttgagcacttattggatgacttgggtccgccaggctccgaggggaaggggctggagtgggggtcggccaaccataacaaaaagataggaaacgtgaacacaacctatgtanaactctgtgatcgggcattcaccgtctccctcacgccctaccaacccgaacgggccccacgttcccgggtccccttccccccgtgggcccgccccgtcgcccgtccgacgggacgcccacccgtccgagacgccacgcggcccggcctcggggctcgccgtggtacgaaacggccttaccgttcccggacttaacgtacgacgttggaacggcggggtcg

SEQ ID NO: 400360 - DNA, 580 bp, Homo sapiens
  misc_feature: GZ8MTXP01ASUTB.15.28.C06.1.454.CMB.2.raw
  modified_base (275)..(275): a, c, t, g, unknown or other
  modified_base (354)..(354): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaacncccaaaagtcctgatctctcgccgctctactttgacaaagtgggtcccatcaaggttcagcgcagtgatcgtagggacngaattcaagtctcaccatcagcaggcctgcagccctgaccgtattttcgactaaacttactactcggacctaagttcgacctaaattaaactaacttccgtaaagttttccggggacgggtaacggggaacccgtaaaggggtggaaagattaaccgaaacggtaaacgtggttaacgggcttaggcccaaactcgttctcgttacctttccgaacgttttccccg

SEQ ID NO: 400361 - DNA, 550 bp, Homo sapiens
  misc_feature: GZ8MTXP01BLALQ.15.28.C06.1.454.CMB.2.raw
  modified_base (422)..(422): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaaatggtgctggttcagcagaacaggaaacacccaaaagtcctgatctctcgccgcctctactttgactaaaggtcgggtccatcaaggttcgagccggcagtggatcgtagggacaagattcagtctcacatcagcagcctgcagcctgacgtatttgactaacttactactcgggactaagtanactaataactatacgtagttcgggacgggaacggacgtaagggtaaggaagttaactaacgaaaacgtacgtgggttacgcgttacgaacctacctaacgttcgtcgttaccttaacgttccttcccg

SEQ ID NO: 400362 - DNA, 586 bp, Homo sapiens
  misc_feature: GZ8MTXP01CM390.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggttggcctggttcagcaagaaaccagggaaacgacccaaaagtcctagatctctcgcccgcctcttactttcgactaaaggtcggggtaccatacgaaggttcgagccggcgagtggatcgtagggacaagaattcacgtctacacatcagcagcctgcagccgtagtacgtatttcgactaaacttactactacgggacctaaaggtacactaattaataaactctaacgtttcgggtacgggacgggtaaccgaagggtaacggaagaacgttaacgaaacggaaacgtgttacgggttcttacggccaacctgttactcgttaccttccttaacgtttcccg

SEQ ID NO: 400363 - DNA, 582 bp, Homo sapiens
  misc_feature: GZ8MTXP01DDZ5K.15.28.C06.1.454.CMB.2.raw
  modified_base (569)..(570): a, c, t, g, unknown or other
  modified_base (572)..(582): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccataacaaaaagatggaagtgacacaacctatgtgaactctgtgatgggccgattcaccgtctccagagacgacgccaaagaactcactacatctgacaaatgaaacaacctgagagccgaggacacggctgtgtattactgtgtgagagattgttctggcggttgggggcccgaaggggaccctggtccaccgtctcctccacgcctccgaaccgaacggggccccagttcccggtcccttccccccgtgggccccgcccctggccctccgaggacgccacccgtccgagacgacacgacggccgggcccgtgggccttcgcccgtgggggtaccgaaacgggtaccttaccgttccgacgtacggtagacgtggacggcgggctgggaacgaagggcgacagtagnngnnnnnnnnnnn

SEQ ID NO: 400364 - DNA, 575 bp, Homo sapiens
  misc_feature: GZ8MTXP01B20A8.15.28.C06.1.454.CMB.2.raw
  modified_base (359)..(359): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaaaccagggaaacgaccccaaaagtcctgatctctcgccgcctctactttgcaaaggtcggggtccatcaaggttcacgccggcagtggatctagggacngaattcagtctcaccatcagcacgcctgccagtcctaggtactaattttcgactaaacttactacttcggaccctaaaggtcactaataataatctaagtttcgggacggtaacgggaccgaaagggtcggaagttagtaaccaaaacggtaacgttggttcgggcttacggccaaccctaattaccgttcgttcctttccgttaacgtttccccg

SEQ ID NO: 400365 - DNA, 580 bp, Homo sapiens
  misc_feature: GZ8MTXP01B8WSV.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagatcaccatcacttgccggccagtcagatattactaaatggtgctgttcagcagaacaggaaacacccaaagtcctgatctctcgccgcctcttacttgactaaaggtcggggtacccatcgaaggttcacggccggcgaggtggatcgtaagggacaagtattcagtctacacatcagcagctgcacgtctagactatttcgactaaacgttactacgtgaccgtaagtacgactaataaactacgttacttacggtttcggggaaccgggtaaagggaaccgtaaggggtaaggaacgttaacttaacgaaaacggtaacgtggttcgggccttggaacctacctaacttcgtgttacccttcgttaactttccccg

SEQ ID NO: 400366 - DNA, 574 bp, Homo sapiens
  misc_feature: GZ8MTXP01CHM5L.15.28.C06.1.454.CMB.2.raw
  modified_base (354)..(354): a, c, t, g, unknown or other
  modified_base (366)..(366): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaccagggaaacgccccaaaagtcctgatctctgccgcctctactttgcaaagtggggtccatcaaggttcagccggcagtggatcgtgggacnggaattcagtcncaccatcagcagcctgcagcctgacgtattttcgactaactttactacttcgggactaagtgactaattaaactaatctagtttccgggacgggtacgggaaccgaaggggtaaggaagagtaaccgaaaccggtaaaccgttggttacggttccttaggaaccctaacccgtaacgttccgtcggttacctttcgaacctttccccg

SEQ ID NO: 400367 - DNA, 602 bp, Homo sapiens
  misc_feature: GZ8MTXP01D15RX.15.28.C06.1.454.CMB.2.raw
  modified_base (250)..(250): a, c, t, g, unknown or other
  modified_base (273)..(273): a, c, t, g, unknown or other
  modified_base (280)..(280): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagagtcaccatcacttgccggcagtcagatatactaatggtgctgttnagcagaacaggaacaccaaatcngatctcncgccgctctactttgacaaaggtcgggtaccatacgtaaggttcaggtccggactaggtagagtcgaagggaacaagtaacttcgagttctacactatacagcacgcctaggcaacgtctagtacgttatttacaacctaaactttactaacgtacggtaaccgtaaaggttcgaactaaattaaactaattaccgtaaaggttttccggggaacggggtaaacggggaaccgttaaagggtaagggaagttaacgtaaacgaaaacgtaacgttggttcggcttacgaacaactcttactcttctttcgttaaccttcccg

SEQ ID NO: 400368 - DNA, 560 bp, Homo sapiens
  misc_feature: GZ8MTXP01AGQQB.15.28.C06.1.454.CMB.2.raw
  modified_base (364)..(364): a, c, t, g, unknown or other
  modified_base (432)..(432): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaaccagggaaacgaccccaaaagtcctgatctctcgcccgctctactttgctaaaggtcggggtccatcgaaggttcaggccggcagtggatcgtagggaacngaaattcgagtctcacatcagcagcctgcagcctgacgtatttgactaacttactactcggacaagtnactaattaataaatcgtaagtttccggggaggtacgggaaccgaagggtggaagttacgtaacgaaacggtaaactggttcgggcttacggccacctaagttcttcggttccttcttaacgttccccg

SEQ ID NO: 400369 - DNA, 590 bp, Homo sapiens
  misc_feature: GZ8MTXP01B8PIE.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtatactaaatggtgctggttcagcagaacaggaaacacccaaagtcctgatctctcgcccgcctctactttgacgtaaaggtcgggtaccagtcgaaggttcaggccggcaggtgagtcgtagggacaagattcagtctacacatcagcagcctgaccgacgtcctaggtaccgttattttcgactaaacttactacgttacggactaaaggtcacaattaaattaactcttaacggtttcgggacgggtaacgggtaaaccgtaaggggtaagggaacgttaacgtaaaccgttaaaacgaacgttggttacggcttacggaacctaccgtaattcgtcgttcttcgttaacgtttcccc

SEQ ID NO: 400370 - DNA, 567 bp, Homo sapiens
  misc_feature: GZ8MTXP01AHJ3Q.15.28.C06.1.454.CMB.2.raw
  modified_base (434)..(434): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaacagggaaacgacccaaagtcctgatctctgccgccttctactttgactaaagtcgggggtcccatacaaggttcagccggcaggtggatgtagggacaagaattcagtctcacatcagcagcctggcagcctagtacgtacttttgactaacttactactcggaccctaaaggttnaactaaataaatactacgtagttcgggacgggaacgggaacgtaagggtaaggaacgttaacgtaacgaaaacgtacgtggttacggcttacgaacctactcgttccgttcgttaccttaacgttcgttcccg

SEQ ID NO: 400371 - DNA, 616 bp, Homo sapiens
  misc_feature: GZ8MTXP01AKTAF.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaccagggaaacgaccccaaaagtcctgactctctcgccgcctctactttgacgtaaagtcgggggtacccagtacgaaaggttcaggcccggacaggtggatcgtagggacaagtaatcagtctcacatcagcagcctggcagcctagacgtatttcgactaaccttactactacggggaccctaaaggtcacctaataaataactcgtaaacgtttccggggacgggtaacgggtaacccgaagggggtcggaaagttaagtaaccgaaaacggtaaaccgttgggttcggggcttacgggaacctaacccgttaacgttccgtacgtttccttaaccgttaaccgttccccg

SEQ ID NO: 400372 - DNA, 661 bp, Homo sapiens
  misc_feature: GZ8MTXP01B1G5O.15.28.C06.1.454.CMB.2.raw
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtcctgagactctcctgtgaagcctctggattcaccttgagcacttattggatgacttgggtccgcaggctccgaggggaggggctggaggtgggtggccaccataacaaaagatggaagtgaacacaacctatagtagaactctgtgagtgggcgtattccaccgtctccctcacgccctaccgaacccgaacggggcccctaagtccggttcccttccccccgtgggccccgccccgtggccctcccgagggacgcccacccgtccggaacgcgccaaccgcgggtcccggccccgttgggggcccttcgggccccgttacggggtacccgttaaaacggggttcccctttaaacccggtttccccggaccgttaaaccgggttacgacccgttgggtaacgggcccgggggtccg

SEQ ID NO: 400373 - DNA, 576 bp, Homo sapiens
  misc_feature: GZ8MTXP01EPHPR.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatattactaaatggttgctggttcagcagaaacagggaaacgacccaaaagtcctgatctctcgccgtcctctactttgacgtaaaggtcgggggtacccagtacgaaaggttcagccggcagtggatcgtagggacaagaattcagtctacacatacagcacgctgcacgtccgtagtacgtattttcgacctaaacttactactacggactaaagtgactaataaatatcgtaagttcggacggtaagggaccgaaagggtgaagttactacgaaacggtaacgtggttacgggcttacggaacctacccgtaattccgtcgttactttccgttaacgtttccccg

SEQ ID NO: 400374 - DNA, 547 bp, Homo sapiens
  misc_feature: GZ8MTXP01CLD20.15.28.C06.1.454.CMB.2.raw
  modified_base (429)..(429): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcaagaaccagggaaagaccccaaaagtcctgatctctcgccgcctctactttgactaaagtgggtccatcaaggttcagccggcagtggatcgtagggacaagaattcagtctcacatcagcagcctgcagcctgacgtatttgactaacttactactgggacctaaggtnacaataaatatctagtttcgggcggtagggaaccgaagggtggaagataacgaaacgtaacgtggttacggcttacggcctaacctaattccgttgttacctttcgaacgtttccccg

SEQ ID NO: 400375 - DNA, 581 bp, Homo sapiens
  misc_feature: GZ8MTXP01ET50F.15.28.C06.1.454.CMB.2.raw
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtgctgttcagcagaaccaggaaacgacccaaaagtcctgatctctgccgcctctactttgacaaaggttcggggtacccagtcgaaaggttcacggccggacaggtggatccgtaaggggacaagtaattcgagtacctacaccatcagacacgtccgcgcgacgacgtacgtacgtacttacgtactaacttactactacggtactaacgtacgtactaataataactacgttacgttacggtacgggtacgggtaacggaagggtaaggaagaacgtaacgaaacgtaacgtacggttacggcgttcgaacactaactctcgttacttcttcgtccg

SEQ ID NO: 400376 - DNA, 547 bp, Homo sapiens
  misc_feature: GZ8MTXP01DL3C8.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctcgccgcctctactttgcaaagtgggtcccatcaaggttcagcgcagtggatcgtgggacngaattcagtctcaccatcagcagcctgcagcctgacgtatttgactaacttactactgggacctaagtgactaataaatatctaagtttcgggacggagggtaccgaagggttggaaagaattaccgaaaacgtaacttggacggttcttacggtccaaccctaagttcctcggttccttcgaactttccccg

SEQ ID NO: 400377 - DNA, 690 bp, Homo sapiens
  misc_feature: GZ8MTXP01DQ10H.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggcagtcagtagtattactaaagtggttggctggttcagcaagaaaccgaggaaacgacccaaaagtcctagactctctcgccgtcctcttaactttgacgtaaaggtcggggtacccagtacgtaaggttcaggtccggacaggtgatcgtaagggaactaaggtaacttacgagttctacgacctataccagcaacggtcctagacacgtcccttagtaacgttatttacgaccttaaacttacctactacggtaccgtaaagttacgaactaaattaaattaacgtacgttaacggtttaccggggacggggaaacggggtaaacccgtaaagggggtaacggtaaacgaaacgttaaaccggaaaaaccggtaaaccggttgggttaacggggcccttacgggaacccctaacccgttaacgtttcccgttacgtttaccctttaaccgttaacccgttttcccccg

SEQ ID NO: 400378 - DNA, 566 bp, Homo sapiens
  misc_feature: GZ8MTXP01BFGU6.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtaacatccagatgacccagtctccgtccaccctgtctgcatctgtcggagacagagtcacatcacttgccgggcagtcagagtattactaaatggtggctggttcagcagaaacaggaaagaccccaaaagtcctgatctctgcccgcctctactttgactaaaggtcgggggtacccatccgaaaggttcagcggccagtggatcngggaacagaattcagtctacaccatcagcagcctgcagcctagacgtatttgacaaacttactactcgaccgtaaaggtcactaattaaataactctaagtttaccggggacggtaaacgggggacctaaagggtggaaagtacttaacaaaacggttaacgtggtaggcttggacctaaccgatctcgtcttactaacttccttaaccccg

SEQ ID NO: 400379 - DNA, 539 bp, Homo sapiens
  misc_feature: GZ8MTXP01AN3X0.15.28.C06.1.454.CMB.2.raw
  modified_base (198)..(198): a, c, t, g, unknown or other
  modified_base (360)..(360): a, c, t, g, unknown or other
  modified_base (428)..(428): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggcagtcagagtattactaaatggttgctggttcagcagaacaggaaacacccaaagtcctgatctctcgcccgcctcttactttgacgtaaaggtcggggtcccatcgaaggttcagccggcaggtgatcgtagggacngatcagtctcacatcagcacgctgcagtcctgtacgtatttacactaacttactactcggactaagtnactaataatatctaagttcggacggtaggacgaagggtgaagacgtaacaaacggtaacgtggacggcttacgaacctactcttcgtcgttacttcgttaacgtttccccg

SEQ ID NO: 400380 - DNA, 564 bp, Homo sapiens
  misc_feature: GZ8MTXP01CI4OX.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccggcagtcagagtattactaatggttggcctggtttcagcaagaaaccgagggaaacgaccccaaaagtcctagactctctcgcccgccttcttactttgactaaaggtcggggtccagtcaaggttcaggccggcaggtggatcggtagggacaagaatttcgagttctacacatcagacacgctgcacgcctgacgtattttacgactaaactttctaactggacctaagtgactaaataataaactcgtagtttcgggaccgggtaaggaccgaagggtaaggaacgagtaacaaacgtaacgtgttcggcttggccactaatctgttacttcgaactttccccg

SEQ ID NO: 400381 - DNA, 556 bp, Homo sapiens
  misc_feature: GZ8MTXP01ARF09.15.28.C06.1.454.CMB.2.raw
  modified_base (197)..(197): a, c, t, g, unknown or other
  modified_base (391)..(391): a, c, t, g, unknown or other
  modified_base (432)..(432): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttcggccggcagtcagatatactaatggtgctgtcagcaagaacaggaacacccaaagtcctagatctctcgccgtcctcttactttcgacgtaaagggtcgggtcccagtcgaaaggttcaggccggacgtaggtggatcgtagggactaagtaactcacgtctcacatacacgacancctgcacgcctagtacgtatttacgacttaacgttactacncgggactagtcactaataactatcgtagttcggcggtaacggaccgaaggtaagaagagtaaccaaaggtaacgtggttacgcttacgaacctacgtaacttctcgttacttcaacgtttcccg

SEQ ID NO: 400382 - DNA, 501 bp, Homo sapiens
  misc_feature: GZ8MTXP01ECIFB.15.28.C06.1.454.CMB.2.raw
  modified_base (354)..(354): a, c, t, g, unknown or other
  modified_base (474)..(474): a, c, t, g, unknown or other
  modified_base (485)..(485): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtgatctgggacngaattcagtctcacatcagcagcctgcagcctgacgtattttgctaacttactacttggccaaagtgacataataatcaatttcggcggtagggaccaagggtgagatacaaagaactgnggcttgcaccntctgttctcaattccc

SEQ ID NO: 400383 - DNA, 496 bp, Homo sapiens
  misc_feature: GZ8MTXP01AMQMV.15.28.C06.1.454.CMB.2.raw
  modified_base (478)..(478): a, c, t, g, unknown or other
  modified_base (482)..(482): a, c, t, g, unknown or other
tcagtctacgtagccacgaccggtgctcgatttagagctcacgtattgggtttggggagtcagactcagtcaggacacagaatggacatgagggtccccgctcagctcctggggctcctgctgctctggctcccaggtgccaaatgtgacatccagatgacccagtctccgtccaccctgtctgcatctgtcggagacagatcaccatcacttgccgggcagtcagagtattactaaatggttggcctggttcagcagaaaccagggaaagcccaaaagtcctgatctctgccgcctctactttgcaaagtgggtcccatcaaggttcagcgccagtgatctggaacagaattcagtctcaccatcagcagcctgcagcctgacgtatttgctaacttacactgccaagtgcataatatcatttcggcggtaggaccaagggtgaagattacgaaacgactgtaggcttagcaacctntctntcttctcttctccg

SEQ ID NO: 400384 - DNA, 523 bp, Homo sapiens
  misc_feature: GZ8MTXP01EGFY3.15.28.C06.1.454.CMB.2.raw
  modified_base (438)..(438): a, c, t, g, unknown or other
  modified_base (481)..(481): a, c, t, g, unknown or other
  modified_base (510)..(510): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacaggaaagacccaaaagtcctagatctctcgccgtcctacttactttgacaaaggtcggggtaccccagttcaaggttcaggccgcagtgatcgtaagggacaagaatcagtctcaccatcagcagcctgcagcctgtaccgtattttgactaacttacacttcgggactaaaggttnactaataataaatctagtttcggacgggaggaccaagggtganataaccaaagactgttagcttagcacctntctcttctcgctc

SEQ ID NO: 400385 - DNA, 615 bp, Homo sapiens
  misc_feature: GZ8MTXP01CC7M1.15.28.C06.1.454.CMB.2.raw
  modified_base (365)..(365): a, c, t, g, unknown or other
  modified_base (387)..(387): a, c, t, g, unknown or other
  modified_base (520)..(520): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctgagactctcctgtgagcctctggattcaccttgagctacttagttggatgtacgttcgggtccgccaggctccgagggggaaggggctggaggtgggtcggccaccataacaaaaagngtaggaagtgacacgaaacctntagtagaactcgtgtgagtgggccgtattccacccgttctccctcacgcccctaccaacccgaaacggggcccctaacgttcccgggtccttccccccgtggccccgtccccgtgcccttcccgagggacccncccgaccgtccgagcgccacgcggcccggccgtggctcgccgtcggtacgaacggttccttaccgtccgacgtaacgtcgacgttggcggcggtg

SEQ ID NO: 400386 - DNA, 670 bp, Homo sapiens
  misc_feature: GZ8MTXP01EUBJ8.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacttgccggcagtcagtagtattactaaagtggttgctggttcagcagaacgaggaaacacccaaagtcctgctctctcgccgtccttcttactttgacgtaaacgggttcggggtaccctagttacgtaaaggttcaggcccggacgtaagggtcggtacgtcggtaaggggaactaaggtaaactttccgaggttcctaccaaccctatacagaccgaacggtcctacggcctaacggtcccgtagtaacgttagttttacgactaaactttacttacgtacggggtacctaaaggttcaactaaattaaagtaacttacgtacggtttcggggacggggtaacgggaaccgaaggggttaaggaacgttaagtaaccgttaaaacggtaacgttggttacgggttcttacggaacctacgtaacttcgttacgttctttaaccgaactttccccg

SEQ ID NO: 400387 - DNA, 582 bp, Homo sapiens
  misc_feature: GZ8MTXP01AFFXI.15.28.C06.1.454.CMB.2.raw
  modified_base (289)..(289): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaacagggaaacacccaaagtctagatctcncgccgccttctactttgactaaaggtcggggtaccatcaaggttcagtccggacaggtgatcgtagggacaagtaacttcgagttctacacatccagcaggcctgcagtcctagacgttattttcgacctaaacttactacgtcggactaaaggtcacaattaataatcgtaagtttcggggacggtaaaggggaccgaaaggggttcggaagttaactaacgaaaccgtaacgtggacgggttcttacggcctaacctaagttccgttcgttcctttaacgaactttccccg

SEQ ID NO: 400388 - DNA, 564 bp, Homo sapiens
  misc_feature: GZ8MTXP01BQBTT.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtggctggttcagcagaaaccagggaaagaccccaaaagtcctagatctctcgccgcctctactttgcaaagtgggtccatcaaggttcagcgcagtggatcgtgggacaagaattcgagtctcacatcagcagcctgcagcctgacgtatttgactaacttactacttggggaccctaaagtgacaattaaataactctaagtttcggacgggaaggggaaccctaaggggtggaagagtacgaaaacgtaaccgttggttcgggttccttaggaacctacccggaatttccgtcggttccttaaccgttaacgtttccccg

SEQ ID NO: 400389 - DNA, 580 bp, Homo sapiens
  misc_feature: GZ8MTXP01B81DN.15.28.C06.1.454.CMB.2.raw
  modified_base (354)..(354): a, c, t, g, unknown or other
  modified_base (380)..(380): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgcctggttcagcagaaaccagggaaagccccaaaagtcctagatctctcgccgcctctactttgcaaagtcgggtccatcaaggttcagccgcagtgatcgtagggacngaaattcagtctcacatcagcagccngcagcgtgtacgtatttcgactaacttactactcggtactaagtctactaattaaacgtaacttactacggtttacgggacgggtaacgggtaaccggtaaggggtaaggaacgttagtaaaccgaaacggtaacgtgggttacggcgttacgaacctaccgtaacgttcgttcgttcctttaaccgttaactttccccg

SEQ ID NO: 400390 - DNA, 829 bp, Homo sapiens
  misc_feature: GZ8MTXP01CO2PW.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagtagtattactaaagtggttggcctggttcagacaagaaaccgaagggaaacgacccaaaagtcctagatctctcgcccgtccttacttacgtttcggacgtaaacgggttcgggggtacccctaagttaccgtaaagggtttccgaagggtaccccggggacgtaacgggttggggtaacgttaccgggttaacgggggaaacctaagggttaaactttaccgtaacggtttacctacccgaaaccctacttacccgaaacggtccgaacgggtccccgttagggaccccgaacgggttaccccgttaacgggtaaaccggtttaacgttttttaccggaaccctttaaaacccgtttaaccctttaacccgttacgggggtaaacccctaaaaggggttaccgtaaaccgtaaaatttaaaacttaaacgtttaccggttaaaccgggttttaccgggggaccggggtaaacgggggtaaccgtaaaggggtaacgggtaaagttaacgttaaacgaaaaccggtaaagtcgggttacgggttcgttaccggtaactaaccctaagttaccgttcgttacctttaacgttaactttccccg

SEQ ID NO: 400391 - DNA, 556 bp, Homo sapiens
  misc_feature: GZ8MTXP01ALT5W.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctcgccgcctctactttgacaaagtcggggtccatcaaggttcagccggcagtggatcgtgggacaagattcagtctcacatcagcagctgcagccctgacgtattttacgactaacttactaactcggacctaaagtgacctaataactaatacgtagtttcggacgggaggaaccgaaggggtggaaagttagtaacgaaaaccgtaatggttagggccttggaacctaccaacttctgttaccttcgaactttccccg

SEQ ID NO: 400392 - DNA, 553 bp, Homo sapiens
  misc_feature: GZ8MTXP01CZ43Y.15.28.C06.1.454.CMB.2.raw
  modified_base (254)..(254): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctcccgtccaccctgtctgcatctggtcggagacagagtcacatcactgccggcagtcagagtatactaagtggtgctgttcagnagaacaggaaacacccaaagtctgatctctcgccgcctctactttgactaaaggtcgggtacccatcaaggttcaggccggcagtggatcgtagggacaagtattcagtctcactatcagcagcctgcagctagacgtatttgactaacttactacttggacctaaggtctactaaataaataacttacgtaacggtttcgggacgggtaacggggaccgaaaggggtggaacgttagtacgaaaacgtaacgtgttacgggcttacggcctactaatcttgttcttccgaagttcccc

SEQ ID NO: 400393 - DNA, 764 bp, Homo sapiens
  misc_feature: GZ8MTXP01C5TIH.15.28.C06.1.454.CMB.2.raw
  modified_base (271)..(271): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtctccgtccaccctgtctgcatctgtcggagacagagtcacatcactgccggcagtcagagtattactaatggtgctgttcagcagaacaggaacacccaaatcnatctctcgccgtctcttactttacgacgtaaaggtcgggtaccctagtacgtaaacggttcacggcccggacgtaggtgggtaacgttcggttaacgggggaaacctaaggtaaactttccgaaacggtttaccctaaccgaaccctaatacccgaacgtacccgaacggtccccgttagacccgtacggtaccccgttagggttaaccgtttaacgtttttacgaaaccttaaaccgtttaaccttaaccgttacggggtaaccccgttaaaagggttacgtaaaccttaaaagttaaaacgttaactttaccggttaaaccgggttttaccgggggaaaccgggggtaaaccggggaaaccggtaaagggggttaagggaaacggttaaacgttaaaccgaaaaccggtaaacggttgggttcgggttcttacgggaaccctaaccgtaactttccgttacggtttcccttaacgttaaccctttccccgg

SEQ ID NO: 400394 - DNA, 592 bp, Homo sapiens
  misc_feature: GZ8MTXP01AWYPN.15.28.C06.1.454.CMB.2.raw
  modified_base (423)..(423): a, c, t, g, unknown or other
  modified_base (456)..(456): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccgggcagtcagtagtattactaaatggtggcctggttcagcaagaaaccgagggaaacaccccaaaagtcctagatctctcgcccgcctctactttgactaaaggtcggggtacccatcgaaggttcaggtccggcagtggatcgtaggggacaagtaattcaagtctacacatcgagcagcctggacaggtccctagtacgtnttttacgactaactttacgtactggactaagtnactaataaactataccgtagttcgggacggacggaaccgaaggggtggaagacgtaacgaaaacgtacgtaggttacggcgttacggaacctacccgaatttcccgtaggttcccttaacgttaaccgtttccccg

SEQ ID NO: 400395 - DNA, 640 bp, Homo sapiens
  misc_feature: GZ8MTXP01A2KGV.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcaagaacagggaaacgacccaaaagtcctagatctctcgcccgcctctactttgacgtaaaggtcggggtacccataccgaaaggttcgaggtccggctagtgggatcgtagggaacaagtaattcgagtcctacaccatcacgcacggcctagccagacctagtacgtattttacgactaaacttactaacctcgggactaaaggttcaactaattaaactaactacgttaacgtttcgggaccggggtaacgggtaccgaaaggggttcggaaagaacgttaaaccgaaaacggtaaaccggttaagggttcggggccttacgggaacccaaccgtaatttcccggtttacgttacccgtttaacccgttaacccgtttccccg

SEQ ID NO: 400396 - DNA, 634 bp, Homo sapiens
  misc_feature: GZ8MTXP01AM10F.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatatactaaatggttggcctggttcagcagaaacagggaaacgaccccaaaagtcctagatctactcgccgcctctactttgacgtaaaggtcggggtcccagtacgaaggttcaggccggacaggtggatcgtagggacaagtatcagtctcacatcagcacggcctagcgacgtcctacgtacgtagtttttcgactaaactttactacgttacggggaccctaaaggttcgactaaattaaacttaaacgttccgtaacgggttttaccggggaaccggggttaaacggggtaacccgaaagggggttaagggaaacgttacgttaaaccggaaacgtaaccgttaggttcgggacttcggaacctaacgtcttcttcggttaccttcgttaacgtttcccccg

SEQ ID NO: 400397 - DNA, 571 bp, Homo sapiens
  misc_feature: GZ8MTXP01ENWFN.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtggctggttcagcagaacaggaaacgacccaaaagtcctgatctctcgccgtcctcttactttgacgtaaacgggttcgggggtaccccaagttccgaaaggtttcaaggccggcgtaggtggactcgtaagggacaaggtaattcagtctcacatcagcagcctgcagcctgtacgtatttgactaacttactactcggactaagtcactaataactaatctagtttcgggacgggtaggaaccgtaagggtggtaagaagtaacgaaaacggtaacgtggttacgcttaggaaccacctaattcgtgttacttcgttaacgttcccc

SEQ ID NO: 400398 - DNA, 528 bp, Homo sapiens
  misc_feature: GZ8MTXP01A3EWZ.15.28.C06.1.454.CMB.2.raw
  modified_base (348)..(348): a, c, t, g, unknown or other
  modified_base (433)..(433): a, c, t, g, unknown or other
  modified_base (514)..(514): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagatattactaaatggttggcctggttcagcagaaacagggaaacgacccaaaagtcctgatctctcgccgcctctactttgacaaagtgggtcccatcgaaggttcagccggcagtggancgtggggacaagaattcagtctacaccatcagcagcctgcagcctgaccgtatttgactaacttactactcgggacctaaggttnactaataataactcagtttcgggcgggaaggtaccgaaagggtggaagatacgaaagtactgttaggcttggcacaatctnttcttcaagttccc

SEQ ID NO: 400399 - DNA, 543 bp, Homo sapiens
  misc_feature: GZ8MTXP01CHNHC.15.28.C06.1.454.CMB.2.raw
  modified_base (341)..(341): a, c, t, g, unknown or other
  modified_base (426)..(426): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatatactaaatggttggcctggttcagcagaaacagggaaagcccaaaagtcctagatctctgcccgcctctactttgcaaaagtcgggggtacccatcaaggttcagcccggnagtggatcgtagggacaagaaattcagtctcaccatcagcaggctgcacgctgacgtattgtcaactactactacgctaagtaanataataataatactacgttacggtacgggacgggaacggaaggtaaggaagaagtaacgaaacgtaaacgtaggttacggcgttcgaactactaactctcgttcttcgttaacgtcc

SEQ ID NO: 400400 - DNA, 566 bp, Homo sapiens
  misc_feature: GZ8MTXP01EMYAG.15.28.C06.1.454.CMB.2.raw
  modified_base (535)..(535): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatattactaaatggtgctggttcagcagaacaggaaacgacccaaaagtcctgatctctcgccgccttctactttgactaaaggtcgggggtacccatcaaggttcaggccggcagtggatcgtagggacaagtaatcagtctacacatcagcagctgcagcctgtacgtattttacgactaaactttactactacggacctaaagtgacaattaaataactcgtagtttcgggacgggaacgggtaaccgaagggtggaagacgtacgaaaacgtaacgtggttacggcgttacgaaccaacctnttacgttgttacttccgttaacgtttccccg

SEQ ID NO: 400401 - DNA, 914 bp, Homo sapiens
  misc_feature: GZ8MTXP01DYXIG.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagagtcaccatcacttgccggcagtcagagtattactaaagtggttggcctggttcagacaagaaaccgagggaaacgacccaaaagtcctagatctctcgccgtcccttcttactttcgacgtaaacggttcgggggtaccctaagttccgtaaacgggtttcaacggccccgggtacgaggttgggaacgttcgtaacgggggaacctaaggtaaatttcccgtaacgttcccttaccaaccctagttacccaacggcccaaacggtccccgttacggacccgtaaccggtaccccgttacggttaaaccgggtttaactttttttaccgggaaccctttaaaaacccgttttaaaccccgtttaacccgtttaaccgggggttaaaacccccgttaaaaggggttttaccgtaaacccgtttaaaaacgtttaaaaagtttaaaaccttttacccgtttaaaacgggggttttttaacccggggggtaacccggggggtttaaaaccggggggaaaccccgggttaaaaggggggtttaaaccgggggaaaaggttaaacgggttaaacccgttaaaaaaaccggggttaaaccccggtttagggggttaaccgggttcccggtttaccgggaaccccgttaaaacccgttaacgttttcccttaccgggttttacccttttcccgttaaacccctttttcccccccggg

SEQ ID NO: 400402 - DNA, 516 bp, Homo sapiens
  misc_feature: GZ8MTXP01AU58E.15.28.C06.1.454.CMB.2.raw
  modified_base (358)..(358): a, c, t, g, unknown or other
  modified_base (394)..(394): a, c, t, g, unknown or other
  modified_base (428)..(428): a, c, t, g, unknown or other
  modified_base (471)..(471): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggtttcagcagaaaccagggaaagccccaaaagtcctgatctctgccgcctctactttgcaaagtgggggtcccatcaaaggttcagcggcagtggatctggggacngaaattcagtctcaccatcagcaggcctgcagcccngtacgattttgctaacttactactggccaaggtncataactaatcattcggcggagggtaccaagggtggaagttanacgaaagaactgttggcttaggcacaatctgttcttcgaattccc

SEQ ID NO: 400403 - DNA, 566 bp, Homo sapiens
  misc_feature: GZ8MTXP01DNN2U.15.28.C06.1.454.CMB.2.raw
  modified_base (355)..(355): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcacatcacttgccgggcagtcagagtattactaaatggtgctgttcagcaagaacaggaaacaccccaaaagtcctgatctctcgccgccttcttactttgacaaaggtcgggtccatcgaagttcagccggcagtggatcgtagggacngaattcagtcacacatcagcagcctgcacgcctgacgtatttcgactaacttactactcggacctaagtcactaataaataactcgtagtttcgggacgggtaacggaaccgaagggttaacggaagttaagtaaaccgaaacggtaacgtgggttacgggttcttacggcctaacctaattccgtcgttaccttccgttaactttccccg

SEQ ID NO: 400404 - DNA, 538 bp, Homo sapiens
  misc_feature: GZ8MTXP01CB3OG.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatattactaaatggtgctgttcagcagaacaggaacgacccaaaagtcctagatctctcgccgtcctcttactttgacgtaaaggtcggggtcccatcgaaggttcaggccggcaggtggatcgtagggacaagattcgagtctcacatcagcacgctgcagcctgacgtatttgactaacttacacttggacctaagtcactaataaataatctagttcggacgggtaggaaccgtaagggtaacggaagagtaacgaaacgtaacggtgacgttgacaactatctgtcttctaacgttccttaacccg

SEQ ID NO: 400405 - DNA, 534 bp, Homo sapiens
  misc_feature: GZ8MTXP01BFRWP.15.28.C06.1.454.CMB.2.raw
  modified_base (271)..(271): a, c, t, g, unknown or other
  modified_base (357)..(357): a, c, t, g, unknown or other
  modified_base (433)..(433): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggttggcctggttcagcagaaaccagggaaanccccaaaagtcctgatctctgcccgcctctactttgacaaagtcggggtccatcaaggttcagccggcagtggatcgtaggggacngaattcagtctacacatcagcacggcctgccagccctgacgtattttcgactaacttactacgtggacctaaggtnacaattaataactcgtacgttcggcgggaaggaccgaagggtgaagatacgaaacgtaacgtcgttaggcttcgctacaatctgttcttcaacgttccccg

SEQ ID NO: 400406 - DNA, 607 bp, Homo sapiens
  misc_feature: GZ8MTXP01CTPHA.15.28.C06.1.454.CMB.2.raw
  modified_base (383)..(383): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgctgttcagcagaaacaggaaacacccgaaaagtcctagatctctcgcccgtcctcttactttgactaaacggtcggggtaccatcgaaggttcaggccggacagtggatcgtagggacaagatcagtctacacatcancagcctgcagctgacgtatttcgactaacttactactcggacctaaggtcactaattaaataacttacgtaacgtttacggggtacggggtaacggggaaccgtaaaggggtaagggaaagaacgttaaacgaaaaccggttaaagtcgggttacggttcgttacggaacctaaacccgtaagtttcccttaggtttccctttaacgttaaccgttttcccccg

SEQ ID NO: 400407 - DNA, 549 bp, Homo sapiens
  misc_feature: GZ8MTXP01DD2DD.15.28.C06.1.454.CMB.2.raw
  modified_base (376)..(376): a, c, t, g, unknown or other
  modified_base (421)..(421): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccggcagtcagagtatactaaatggttgctggttcagcagaaacaggaaagcccaaaagtcctgatctctgccgctctactttgacaaaggtgggccatcaaaggttcagccggcagtggatcgtagggacaagaaattcaagtctacacatcagcagcngcacgcgtacgtagtattactactaactactactacgacaagtanactaataaataatactacgtacggtacgggacggaacggaaggtaaggaagaagtaaacgaaacgtaaacgtacgttacggttcgttacgaacaactaacttcttacgttacttaacgttaacgtccg

SEQ ID NO: 400408 - DNA, 571 bp, Homo sapiens
  misc_feature: GZ8MTXP01DE219.15.28.C06.1.454.CMB.2.raw
  modified_base (360)..(360): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcacatcacttgacggcagtcagagtatactaatggttgctgttcagcagaacaggaaacgacccaaagtcctgatctctcgccgccttcttactttgacgtaaaggttcggggtcccatacgaaggttcgagccggcagtggatcgtagggacngtaaattcacgtctacaccgtatcacgcacgcctgcacgcgtgacgttatttcgactaacttactacgtcgacctaagtcgtactaataactagtactagtttccgggaggtaacggaccgtaagggtcggaagttactaacgaaacgtaacgttggttcggcttaggccctaactaattccgtcgttcctttaaccaacgttttcccccg

SEQ ID NO: 400409 - DNA, 609 bp, Homo sapiens
  misc_feature: GZ8MTXP01DX1CB.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtatactaaatggtgctgttcagcagaacaggaaacgacccaaagtcctgatctctcgccgcctctactttcgactaaaggtcggggtacccagtaccgaaggttcacggccggcaggtggatcgtagggacaagaattcaagtctacacatcagcacgtcctgcaacgtcccgtagtaccgtattttacgactaactttactactggtacccaagttcaactattaaatatacgtagtttacgggacgggtaacgggaccgaagggtaacggaagttacgtaaacgaaaaccggtaaagttcgggttaacggttcgttcggaacctaaaacccgttcgtttaccgttaccgttacctttaaccgttaaccgtttccccg

SEQ ID NO: 400410 - DNA, 607 bp, Homo sapiens
  misc_feature: GZ8MTXP01AFS3K.15.28.C06.1.454.CMB.2.raw
  modified_base (302)..(302): a, c, t, g, unknown or other
  modified_base (353)..(353): a, c, t, g, unknown or other
  modified_base (409)..(409): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagcacttatggatgacttgggtccnccaggctccgaggggaaggggctggagtgggtcggccaccataacaaaagntaggaagtgaccacaactatgtagaaacctgtgtgagttggggcctattcacgtcnccagagacgacgccaagactcactacattcagacaaatcggaaacaaccgtgaacgacggacccgagggacctaaccggggtcgttggttagttacgttacgtggtggttaggtaaggagtacgttgttcggttcgggttccggggttcggggacccgtaacggggtacccgtcgggttaccctcccgttccgtcccg

SEQ ID NO: 400411 - DNA, 586 bp, Homo sapiens
  misc_feature: GZ8MTXP01AGRE0.15.28.C06.1.454.CMB.2.raw
  modified_base (430)..(430): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaagtcggggtccatcaaggttcagccggcagtggatcgtagggacaagattcagtctcacatcagcagcctgcagcctgacgtatttgctaaacttactacgtcggtaccaaaggttnactaattaaataactcgtaaagttttccggggacgggtaacgggaaccctaaaggggtggaacgttaacgtaacgaaaaccggtaaagtcgggttacgcgttacggaaccctaaccgtaacttcgttacggttcctttccgaaccgttttcccccg

SEQ ID NO: 400412 - DNA, 660 bp, Homo sapiens
  misc_feature: GZ8MTXP01CPSXK.15.28.C06.1.454.CMB.2.raw
tcagtctacgtagccacgaccggtgctcgatttagagctcacgtattgggtttgggggagtcgagactcagtcaggacacagcatggacatgagggtccccgctcagctcctggggctcctgctgctctggctccaggtgccaaatgtgacatccagatgacccagtctccgtccaccctgtctgcatcgtgtcggagacagacgtcacatcacgtgccggcagtcagtagtattacaaagtggtgctggttcagcaagaacgaggaaacaccccaaagtcctagatcctctcgcccgccttcttactttgacgtaaagggttcgggacccagtacgaagggttcacggtccggacgaggttggaatccggtaagggactaaggtaaatttccgaaggttccaccgaactaactcaaggaccacgtccgtacgacgacgtacgttacgtacgtttactttacgaaccttaaacgtttacgtacgtacggtaacgtaaggtactaactaaattaaacttaacgttacgttaacgggttaccgggaacggggtaacggtaaccggtaaggggtaacgaaacgttaacgtaaacggaaacggtacgtgggttacgcttacgaacctacttcgttcgttcttaccttaacgttaaccgttcccg

SEQ ID NO: 400413 - DNA, 559 bp, Homo sapiens
  misc_feature: GZ8MTXP01C0O1N.15.28.C06.1.454.CMB.2.raw
  modified_base (550)..(550): a, c, t, g, unknown or other
tcagtctacgtagccacgaccggtgctcgatttagagctcacgtattgggtttggggggagtcagactcagtcaggacacagcatggacatgagggtcccgctcagctcctggggctcctgctgctctggctcccaggtgccaaatgtgacatccagatgacccagtctccgtccaccctgtctgcatctggtcggagacagagtcacatcacttgccgggcagtcagagtatactaaatggttgctggttcagcaagaacgaggaaacgacccaaaagtcctgactctctcgccgtccttcttactttgacgtaaaggttcggggtaccctagtacgaaggttcgaggtccggactaggtggatcggtaagggacaagtactcgagtctacacagtcagcacgcctgcagccgtgtacgtatttcgactaacttactacacgactaagtcactaataatactactacgttcggggacgtagggaacgaagggtgaagagtaacgaaacgtacgtggttcggcttgcctaacgtcttctacgttcttccnctttccccg

SEQ ID NO: 400414 - DNA, 525 bp, Homo sapiens
  misc_feature: GZ8MTXP01E4Z7K.15.28.C06.1.454.CMB.2.raw
  modified_base (426)..(426): a, c, t, g, unknown or other
  modified_base (506)..(506): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcacatcacttgccggcagtcagagtattactaaatggtggctggttcagcagaaccaggaaagaccccaaaagtcctagatctctgccgcctctactttgacaaaggtggggtacccatcaaggttcagccggcagtggatcgtagggacaagaattcagtctcaccatcagcagccctgcagccctgacgtattttgctaacttacactggaccaagtnacaataatatctagttcggaggaaggaccgaaagggtggagactacaaacgtaacgtgttaggcttcggccactaatctnttaccttcaactttccccg

SEQ ID NO: 400415 - DNA, 571 bp, Homo sapiens
  misc_feature: GZ8MTXP01E2ZFA.15.28.C06.1.454.CMB.2.raw
  modified_base (362)..(362): a, c, t, g, unknown or other
tcagtctacgtagccacgaccggtgctcgatttagagctcacgtattgggtttggggggagtcagactcagtcaggacacagcatggacatgagggtcccgctcagctcctggggctcctgctgctctggctcccaggtgccaaatgtgacatccagatgacccagtctcccgtccaccctgtctgcatctggtcggagacagagtcaccatcacttgccgggcagtcagatattactaatggtgctggttcagcagaaacagggaaacgaccccaaaagtcctagatctctcgccgtcctcttactttgacaaaggtcggggtccatacaaggttcgagccggcaggtggatcgtaggganaagtaatcagtctcacatacagcacgctgcagccctgtaacgtattttcgactaacttactactggacctaaggtcactaaataataattactacggtttcgggacgggtaacgggaaccgaagggtggaaagacgtaacgaaaacgtaaacgtgggttcggcttcggaacctacctaagtttctacgttccttcgttaactttccccg

SEQ ID NO: 400416 - DNA, 501 bp, Homo sapiens
  misc_feature: GZ8MTXP01DLT78.15.28.C06.1.454.CMB.2.raw
  modified_base (352)..(352): a, c, t, g, unknown or other
  modified_base (485)..(485): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacagggaaagccccaaaagtcctgatctctgccgcctctactttgcaaagtggggtccatcaaggttcagcggcagtgatctagggacngaattcagtctcacatcagcagcctgcagcctgacgtatttgctaacttactactggaccaaagttgacataaataatcagtttcggcggaggaccaagggtgagatacaaacgaactgttaggcttagcacntctgttcttcaattcc

SEQ ID NO: 400417 - DNA, 546 bp, Homo sapiens
  misc_feature: GZ8MTXP01EJ5PY.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaaatggttggctggttcagcagaaaccagggaaagaccccaaaagtcctagactctctcgccgtcctctactttgactaaagtcggggtcccatcaaaggttcagccggacagtggatcgtagggacaagaattcagtctcaccatcagcagcctgcagccctagacgtattttcgactaacttactactgctaaagtgacattaaataatcgtagtttacgggcgggtaagggaccaaagggtggaaagagtaacgaaaacgacgtagttgggcttggaactacaattctcgttcttcgaactttcccg

SEQ ID NO: 400418 - DNA, 563 bp, Homo sapiens
  misc_feature: GZ8MTXP01CVDAD.15.28.C06.1.454.CMB.2.raw
  modified_base (250)..(250): a, c, t, g, unknown or other
  modified_base (252)..(253): a, c, t, g, unknown or other
  modified_base (265)..(265): a, c, t, g, unknown or other
  modified_base (277)..(277): a, c, t, g, unknown or other
  modified_base (439)..(439): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccggcagtcagatattactaaatggtgctggttnannagaacaggaaanacccaaagtccngatctctgccgctctactttgactaaaggtcgggtaccatcgaaggttcagccggacagtggatcgtagggaacaagtaactttcagtcctacaactagtcagcacgtcctgacacggctcggtaactatttacgactaacttactaccgtggtaccaagtnactaaataaataactcgtaacgttcgggaacggtaagggaccgaaagggtggaaagataaacgaaacgtaagtgttcgggcttcggaacctaacgtcttacctgttccttaacgttcttccccg

SEQ ID NO: 400419 - DNA, 607 bp, Homo sapiens
  misc_feature: GZ8MTXP01CPVXJ.15.28.C06.1.454.CMB.2.raw
  modified_base (309)..(309): a, c, t, g, unknown or other
  modified_base (355)..(355): a, c, t, g, unknown or other
  modified_base (463)..(463): a, c, t, g, unknown or other
  modified_base (490)..(490): a, c, t, g, unknown or other
  modified_base (510)..(510): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctctggattcaccttgagctacttattggatgacttgggtccncaggctccgaggggagggctggagtggtggccacataacaaaaagnaggaacgtgacacaaacctatagtagaactctggtgagtcggggacctattccacccgttctcctcacgccctcccgacgaacgggcccacgtccgtccttcccccgnggcccgcccgtcgtcctccgacggacncccaccgtccggagcgaccnccgacggcccggcccgtgggcctcggaccgttcggtcgaacggttccttacccgttcccggcctaacggtgtacccgttagggaacggcgggtccgg

SEQ ID NO: 400420 - DNA, 768 bp, Homo sapiens
  misc_feature: GZ8MTXP01CYDGI.15.28.C06.1.454.CMB.2.raw
  modified_base (200)..(200): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctgtcgganacagagtcacatcactgccggcagtcagtatattaactaagtggtgctgttcagacaagaaacgaggaaacgacccaaagtcctagactctctcgcccgccttacttactttcggacgtaaacgggttcgggtaccctagtaccgtaaaggttcgaacggcccggactaaggtggtaacttccggtaaacggggaactaagggtaaactttccgaacgttccctaaccaaccctagtaccgaacgccgaacgtccccgtagacccgtaagtcccgtaggttaacgttaacgttttaccgaaacccttaaacctttaaccgttaacgttaccggggaaaccgtaaacggttcgaaacccttaaaagttaaaacgttaaaccgtttaccggtttaaaccggggtttccgggggaaaccgggggtaaacgggggtaaacccgtaaaagggggttaaggaaacggttaaacgttaaaccggaaaaccggtaaaccgtttgggaaccggttccttacggaacccctaaacgtctttccgttacgttaccctttaaccttaaccgtttcccccg

SEQ ID NO: 400421 - DNA, 601 bp, Homo sapiens
  misc_feature: GZ8MTXP01A4ZA9.15.28.C06.1.454.CMB.2.raw
  modified_base (362)..(362): a, c, t, g, unknown or other
  modified_base (600)..(600): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtccctgagactctcctgtgaagcctctggattcaccttgagcacttattggatgacgttgggtccgccgaggctccgaggggaaggggctgggagtgggtgccaaccataacaaaaagntaggaagtggaacacgaaacctatagtgaactctgtgagtggggccgtatttccacccgttctccctcacgccctcccaacccgaacgggccccagttcccgggtcccttcccccgtggccccgtccccgtacgcctcccgaggacgccacccgtccgagacgcacgcgccggccccgtggggctcgccgtggtcaagggccttaccgtccacgtaacggtagccttggcggccgggng

SEQ ID NO: 400422 - DNA, 537 bp, Homo sapiens
  misc_feature: GZ8MTXP01EBATP.15.28.C06.1.454.CMB.2.raw
  modified_base (266)..(266): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggtgctggttcagcagaacaggaaanacccaaagtcctgatctctcgccgcctctactttgacgtaaaggttcggggtacccatcgaaggttcagtccggctaggtggatcgtagggacaagattcagtctcacatcagcagcctgcagccgtagtacgtaattttgacctaactttactaccttggacctaagttcactaataacgtatactagttcggacggagggtaccgaggtaaggagatacgaaacgtagtgttaggcttagcctacaattctagttcttcgttcttcccg

SEQ ID NO: 400423 - DNA, 651 bp, Homo sapiens
  misc_feature: GZ8MTXP01D8S3P.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatcgtgtcggagacagacgtcaccatcacttcggccggcagtcagtagtattactaaagtggtggctggttcagcaagaaacgaggaaacgacccaaagtccgtagactctctcgcccgtccctacttacgtttcggacgtaaacgggttcgggggtaccctagttacgtaagggttccagggcccggacgtaggtggatcggtaacggggaactaaggaaacttcgaacgttcctacaccgatccgaagcacggcctcgcacgtcctagacgttatttcgactaaccttactacgtcgggtactaaaggtcaactaattaaactaagttacttaacgggtttccgggagggtaaacgggtaccgtaaaggggttaacgaaagttaactaaacgttaaaacggtaaacgtgggttaacggcttacggctacctaagttcctacgttcttccgaactttccccg

SEQ ID NO: 400424 - DNA, 608 bp, Homo sapiens
  misc_feature: GZ8MTXP01B62Q0.15.28.C06.1.454.CMB.2.raw
  modified_base (300)..(300): a, c, t, g, unknown or other
  modified_base (596)..(608): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaaagaactcactacatctgcaaatgaaacaacctgagagccgaggacacggctgtgtattacngtgtgagagatgttctggcggttgggggcccaaggggaccctggtccaccgtctcctccacgcctccgaacccgaacggggcccccaagttcccgggtccctttcccccccgtggggcccctcccccgttggcccttacccgagggacgcccacccgtccggagacgaccaccgacggcccgggcccgttcggggcctcggccccgttagggggtacctaaacggggtacccttaccgtttcccgacgtaccggtagaccgtggacggcggggactgggaacaagggcgcagtagnnnnnnnnnnnnn

SEQ ID NO: 400425 - DNA, 600 bp, Homo sapiens
  misc_feature: GZ8MTXP01ENNHG.15.28.C06.1.454.CMB.2.raw
  modified_base (260)..(260): a, c, t, g, unknown or other
  modified_base (456)..(456): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttcggccgggcagtcagtagtattactaaagtggttggctggttnagcaagaacaggaaacgacccaaagtcctgatctctcgccgtccttctactttgacgtaaacgggtcgggtacccatacgtaaggttcaggccggcaggtggatcgtaagggacaagtaatcgagtcctaccacatcagcacgcctagcagtccgtagtacgtatttcgacttaacttactacgtcgacgtaagtnaactaataactaattcgtacggtttcggggacgggtaacgggaaccgtaagggtaaggtaaggttaactaaacgaaacggtacgtgggttacggttcgttacgcctaaccgtcgttcgtcgttccttaaccgttcgtttccccg

SEQ ID NO: 400426 - DNA, 609 bp, Homo sapiens
  misc_feature: GZ8MTXP01BAH0H.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaagtggtggctggttcagcaagaaaccgagggaaacgaccccaaaagtcctagactctctcgccgtcctcttactttgacgtaaaggtcggggtacccagtacgaaggttcaggccggacgtagtggatcgtaagggaacaaggtaatcgagtcctacacctatcagcagcctgcacgcctagtacgtatttcgactaacttactacgtcggacctaaggtctactaattaactaagttacgttaacggtttccgggaacgggttacggggaaccgtaaggggtggaaacgagttaaaccaaacggtacgtaggttacggcttacggaaccctacctaacgttcgttcgttaccttaaccttccgttaaccccg

SEQ ID NO: 400427 - DNA, 614 bp, Homo sapiens
  misc_feature: GZ8MTXP01CUG9Q.15.28.C06.1.454.CMB.2.raw
  modified_base (198)..(198): a, c, t, g, unknown or other
  modified_base (381)..(381): a, c, t, g, unknown or other
tcagtctacgtagccacgaccggtgctcgatttagagctcacgtattgggtttggggggagtcagactcagtcaggacaaagcatggacatgagggtccccgctcagctcctggggctcctgctgctctggctcccaggtgaccaaatgtgacatccagatgacccagtctccgtccacctgtctgcatctgtcgganacagatcaccatcactgccggcagtcagtatattactaatggtgctggttcagcaagaacgaggaaacacccaaagtcctgatctctcgcccgtctctacttgacgaaaggtcgggtacccagtacgaagttcgagcgaccgaggtggatcgtaggaaacaagtaacttcagtctacgaaccntacagctacgcctcggacacgtacccgttaagtaccgttaattttcgaacccttaaacgtttactacgtacgtacctaaggtctaaacctaataaacttaacgtcgttaaggtttaccggggaacggtaacggggtaaccaaaggggttcgaaagtaacaacgaaaaccgttagtggtcggttacttcgaccctaacagttcctagttccttacttaaccttccgttaacccg

SEQ ID NO: 400428 - DNA, 549 bp, Homo sapiens
  misc_feature: GZ8MTXP01A84E2.15.28.C06.1.454.CMB.2.raw
  modified_base (363)..(363): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgctggttcagcagaaaccagggaaacgcccaaaagtcctgatctctcgccgtcctctactttgacgaaaggtcgggggtacccatacaaggttcagccggcagtggatcgtagggacngaatcagtctcacatcagcagcctgcagcctagtacgtatttcgactaacttactactcggacctaaggtcactaataataatcgtaagtttcgggacgggtagggaaccgaagggtggaagataacgaaacggtaacgtggttacggcttcgcctactaattcgtcttcttccgttaacttcccc

SEQ ID NO: 400429 - DNA, 563 bp, Homo sapiens
  misc_feature: GZ8MTXP01E05WJ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaacaggaaagacccaaaagtcctgatctctgccgcctctactttgcaaagtgggtccatcaaggttcagccgcagtggatcgtagggacaagaaattcgacgtctacaccatacagcaggcctagcagcctagtacgtatttagactaacttactaactgggtacctaaaggtcacaattaaactaattacgtaacgtttcgggacggggtaacgggaacctaaaggggtggaacgagtaccgaaaacgtaacgtggttacgggttcttaggccactaagttctcgttcctcgttaacgtttcccg

SEQ ID NO: 400430 - DNA, 561 bp, Homo sapiens
  misc_feature: GZ8MTXP01ENUJD.15.28.C06.1.454.CMB.2.raw
  modified_base (268)..(268): a, c, t, g, unknown or other
  modified_base (280)..(280): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaacaggaaacncccaaaagtccngatctctcgccgcctctactttgacaaaggtcgggtccatcaaggttcagccgcagtcggatcgtagggacaagaattcagtctacacatcagcacggctgcagcctagtacgtatttgacctaacttactactgggaccaaggtcactaataagtaactcgtagtttcgggacgggaaggtaaccaaggggttaaggaagttaactaacgaaacgacgttggttcggcttacggaacctaacctaacgtttcgtacgttaccttttcgaacgtttccccg

SEQ ID NO: 400431 - DNA, 570 bp, Homo sapiens
  misc_feature: GZ8MTXP01ANXB3.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacagggaaagccccaaaagtcctgatctctgccgctctactttgcaaagtggggtcccatcaaggttcagccgcagtgatcgtgggacngaattcagtctcacatcagcagctgcagcctgacgtattttgactaacttactactggaccaaagtgactaataaatatactagtttcggcgggtaagggtacccgtaaagggtcggaagttaaacgtaccgaaaacggtaaccgtaggttacgggcgttacggaacctaaccccgtaattcccggttcgttcctttaaccgttaacttttcccccgg

SEQ ID NO: 400432 - DNA, 586 bp, Homo sapiens
  misc_feature: GZ8MTXP01EVXQR.15.28.C06.1.454.CMB.2.raw
  modified_base (402)..(402): a, c, t, g, unknown or other
  modified_base (444)..(444): a, c, t, g, unknown or other
  modified_base (521)..(521): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcaggcagaaaccagggaaacgcccaaaagtcctgatctctcgccgcctctactttgcaaaggtcgggggtacccagtcaaggttcaggccggcagtggatcgtagggacaagaattcagtctcaccagtcagcagcctgcaggccngacgtattttcgactaaacttactactagggacctaaaggtnacaattaaataactactagtttccgggcgggtaagggacccgtaaagggtgggaagacttaacgaaacgaaccggtnttacggggttcttcgggaaccaccgtaacgttccttcggttcctttaaccgttaacgtttccccg

SEQ ID NO: 400433 - DNA, 603 bp, Homo sapiens
  misc_feature: GZ8MTXP01C94E0.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcacgttgccggcagtcagagtattactaatggtgctggttcagcagaacaggaaacacccaaagtcctagactctctcgcccgccttcttactttcgacgtaaaggttcgggggtaccctagttacgaaggtttcgaggtacccggctaggtcggatcgtaggggaacaagtaacttcgagtctacacatcagcagcctgcacgctagtacgtatttcgactaacttactacgtcggacctaagtcgaactaattaaatacttacgtaacgtttcggggacgtaacggggtaccaaaggggtcggaaagacgttaaccgaaaacggtaacgttggttacggttcttacggaacctaccgtaacttactcgttacttccgttaacctttccccg

SEQ ID NO: 400434 - DNA, 556 bp, Homo sapiens
  misc_feature: GZ8MTXP01AMSHL.15.28.C06.1.454.CMB.2.raw
  modified_base (174)..(174): a, c, t, g, unknown or other
  modified_base (316)..(316): a, c, t, g, unknown or other
  modified_base (401)..(401): a, c, t, g, unknown or other
  modified_base (517)..(517): a, c, t, g, unknown or other
  modified_base (543)..(544): a, c, t, g, unknown or other
  modified_base (546)..(556): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccataacaaaaagntggaagtgacacaacctatgtgaactctgtgatgggccgattccaccgtctccagagacgacgccaaagaactcactacatctgcaaatgaacaacctgagagccgaggacacggctgtgtattatgtgtgagagatgttcnggtcggttgggggccaggggaaccctggtccaccgtctcctcacgctccaccgagggccccagtccggtcctcccccgtggcccncccgtgcctccgaggcgccaccgtccgagacgcaacgcggccggcccgtggggctcgccgtggggtacaacggtacctaccgttccgcgttacgtagacctggacggccgggtcgngggcgaagggttcgaccgttagtagnngnnnnnnnnnnn

SEQ ID NO: 400435 - DNA, 589 bp, Homo sapiens
  misc_feature: GZ8MTXP01EUXLP.15.28.C06.1.454.CMB.2.raw
tcagtctacgtagccacgaccggtgctcgatttagagctcacgtattgggtttgggggagtcagactcagtcaggacacagaatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggtgctgttcagcagaacaggaaacacccaaagtcctgatctctgccgcctctactttgacaaaggtcggggtcccatcgaagttcagcggccaggtggatcgtgggaacagtaattcagtctacacatcagcagcctgcacgctagacgttatttcgactaacttactactacgaccgaagttgactaattaaataactcgtaagtttacggggacgggtaacgggaaccgtaaagggtggaagtaacgttaaaccgaaaacggttaaccgttgggtacggttccgttcggacccgtaaccctattccgtttcggtttccttaccgtaacctttccccgtttcccccg

SEQ ID NO: 400436 - DNA, 480 bp, Homo sapiens
  misc_feature: GZ8MTXP01BGGFF.15.28.C06.1.454.CMB.2.raw
  modified_base (367)..(367): a, c, t, g, unknown or other
  modified_base (437)..(437): a, c, t, g, unknown or other
  modified_base (469)..(480): a, c, t, g, unknown or other
tcagtctacgtagccacgaccggtgctcgatttagagctcacgtattgggtttgggggaagaggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgacaaatgaaaaacctgagagccgaggacacggctgtgtattactgtgtgagagatgttctgcgtgggccagggaccctggtcaccgtctcctcagccctccaccaacggggccccagtccggtccttccccccgtggcccgcccctggcctcccaggcnccacccctccgagacgcacagccggcccgtggggcctgccctgggtacaagggtctactccgctacgtanacgtgaggcgggctgggcaaggcgacataggnnnnnnnnnnnn

SEQ ID NO: 400437 - DNA, 557 bp, Homo sapiens
  misc_feature: GZ8MTXP01C8PYD.15.28.C06.1.454.CMB.2.raw
  modified_base (285)..(285): a, c, t, g, unknown or other
  modified_base (441)..(441): a, c, t, g, unknown or other
tcagtctacgtagccacgaccggtgctcgatttagagctcacgtattggggtttggggggagtcagactcagtcaggacacagcatggacatgagggtccccgctcagcccctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaaacaggaaacacccaaaagtccngatctctgccgcctcttactttcgacgtaaaggtcgggtcccagtacgaaggttcgaggcggaccaggtggagtcgtaggggaaacagtaattcagtctacacatcacgcagctgcagcctagacgtatttcgactaacttctactcgactaagtnactaataataatctagttcgggaggtaacggacaagggtggaaagtaacttaacgaaacgacgtaggtcggacttcgaccaactattcgttgttccttactaacttcccgttcccg

SEQ ID NO: 400438 - DNA, 702 bp, Homo sapiens
  misc_feature: GZ8MTXP01CCH1R.15.28.C06.1.454.CMB.2.raw
  modified_base (253)..(253): a, c, t, g, unknown or other
  modified_base (257)..(257): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcaggtatataatagtggtcgcgttgtanaganaacgaacggaaggaacccaaaccgtaaactcgtatactcctcgccgcccgtcttacttacgttacgaaacggtaacggggtccggtacctagtaaccggttaacgtcgacggtccggacgtagggtacgtactcggggtaaacggaaccgtaagttaacttaccggtaacgttaccctaacccaaacccgttaacgtaccgacgtacgaccgtccgtacgacgtaccgttacgtacgttatttacgtacaacttaacttactacgtacggaagttaagtacaactaaattaaacgttacgttacggttacgggtacggggaacggggtaaacggtaaacgggtagggtaaacgtaaacgttaacgtaaaaccggaaacgttcggtcggttacgcacgtaaccctacttcgttcgttaccttaccttaaccgttccccgtttcccg

SEQ ID NO: 400439 - DNA, 723 bp, Homo sapiens
  misc_feature: GZ8MTXP01A6MJZ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagtagtattactaatggtgctggttcagcagaaacgaggaaacacccaaagtcctgactctctcgccgtcctacttacgtttcgactaaacgggtcgggtaccctagtacgtaaggttcaggccggacgtaggtggaatcggtaagggaactaaggtaaactttccgaacgttcctaccgaacctacttacccgaaggccaacggcccgtaggccaaggtccccgttagggtaacccgttatttttacggaaccttaaacctttaacgtaccgttacggggaacccgtaaaggtttaccgaaacgttaaacttaaagttaaacgttaccgttaaacggggttttaccggggaaccgggggtaaacgggttaaacccgaagggggttaacggaaagttaacggttaaaccgaaaaccgggtaagtcgggttacgggacttacgggaaccctaacctcggtttccgtacgtttcccttaacgttaaccgttttcccccg

SEQ ID NO: 400440 - DNA, 637 bp, Homo sapiens
  misc_feature: GZ8MTXP01ANX8I.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccggcagtcagtagtattactaaagtggtggcctggttcagcaagaaaccgaggaaacgacccaaaagtcctgatctctcgcccgtccttcttacgtttcggacgtaaacgggtcggggtacccagtacgaaggttcaggccggcaggtggatcgtaagggacaagtaactcagtctacaccatcacgcacggcctcggacacgtccgtagtacgttattttcgaccttaaacttactacgtacgggtactaaaggttcaactaaattaaacttaacgttacgtaacggtttccgggggaacgggtaacggggtaaccgtaaaggggtaagaaacgttacgtaaaccgaaacgggtaacgtgggttcgttcgttacgaactacctaacttcgtcgttcctttaacgaaccgtttccccg

SEQ ID NO: 400441 - DNA, 592 bp, Homo sapiens
  misc_feature: GZ8MTXP01BV0ZW.15.28.C06.1.454.CMB.2.raw
  modified_base (364)..(364): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggcctggttcagcagaaaccagggaaacaccccaaaagtcctgatctctcgccgcctctactttgacgtaaagtcggggtcccatcgaaggttcagccggcagtggatcgtagggacngaattcagtctacacatcagcagcctgcagcctgacgtatttcgactaaacttactactggacctaagtcgactaataaactatcgtaagtttccggggacggtaacgggaaccgtaagggtgggaaacgaacgttaaccgaaaacggtaaccgttggttacgggttccttacggaacctaaccccgtaatttccgtcgtttaccttaaccgttaaccttttcccccg

SEQ ID NO: 400442 - DNA, 560 bp, Homo sapiens
  misc_feature: GZ8MTXP01BXNT5.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggttcagcagaaaccagggaaacgaccccaaaagtccctgatctctcgccgcctctactttcgacaaaggtcgggtccagtcaaggttcagccggcaggtggatcgtaagggacaagtatcagtctcaccatccagcacgctgcagccctgtacgtatttgactaacttactacgtggcctaagtgacaataataatacgtagtttaccgggaggtaacgggaccgaaagggtggaagaagttaaccgaaacgtaaacgtggttacgcttcggaacacctaacttcgtacgttctttaaccgcgtttcccg

SEQ ID NO: 400443 - DNA, 706 bp, Homo sapiens
  misc_feature: GZ8MTXP01D7AI9.15.28.C06.1.454.CMB.2.raw
  modified_base (199)..(199): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagagtcacatcacgttgccggcagtcagtatattaactaaagtggttcgcgtgttcagacaacgaaaccgaaggaaacgacccgaaacgtacctgactctcgtacgccgtccttacttacttcgacgtaaacggtcgggtaccagtacgtaacggttacgacgtaccgggacgtaggtacggtagtacggttaacgggaactaacggtaaactttacgtaccggttacctaacccaacccgtacgtacacggaccacgggtcccgtacgacgtacgtaccgtacgttaacgttacgtttacgtaaccttaacttaaccgttacgtacggtaaccgtaagttacgtaactaaattaaacgttaacgttacgttaacgggttaccggggaacggggtaacgggtaacgtaaagggtaacggtaaacgttaacgtaaacggaaacgtacgttaggcgttcgacgtaaccacttaacgttcgttacttaccttccgttaaccgttcccg

SEQ ID NO: 400444 - DNA, 579 bp, Homo sapiens
  misc_feature: GZ8MTXP01A0MZW.15.28.C06.1.454.CMB.2.raw
  modified_base (541)..(541): a, c, t, g, unknown or other
tcagtctacgtagccacgaccggtgctcgatttagagctcacgtattgggtttgggggagtcagactcagtcaggacacagaatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacagggaaagcccaaaagtcctgatctctgccgcctctactttgcaaaggtgggtcccatcaaggttcagcggccaggtgatcgtgggaacagaattcagtctcacatcagcagcctgcagcctgacgtatttcgactaacttactactcgacctaagtgactaattaataatcgtaagtttaccggggcggtaaacggggtaacccgaaaggggttggggaaataacgttaccgaaaacggaccgttaggtacggggacttcggaccgtaaacccttnttccgttcgttaccttactaaccgtttcccgtaacccg

SEQ ID NO: 400445 - DNA, 859 bp, Homo sapiens
  misc_feature: GZ8MTXP01DTQFY.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcacatcacttggccggcagtcagatattactaaatggttgctggttcagcaagaaacaggaaacacccaaaagtcctagatctctcgccgtccttacttactttgacgtaaaacgggttcgggggtacccctaagttaccgtaaaggggtttcgaaacgggtccccgggtaccgtaaggggttcggggtaacgttaccgggtaaacggggggtaaaccctaagggtaaaacttttacccgtaaaccgggtttacccttacccgaaaccccgtaaattacccgaacggtacccgaaacggtccccgttacggacccgtaacgggtaccccgtttaggtaaacccgggtttaatttttaccgggaaacccttaaaaccgttttaacctaacccgttacgggggtaaccccttaaaggggttaccgtaaaccttaaaatttaaaacttaaacgtttaccggttaaacgggttttaccgggggaaccgggggttaaacggggaaacccggttaaaagggggttaacgggaaagggttaaacttaaaccggttaaaaaacggttaaaccgttggggttacggttccgtttacggaacccgtaaaaccgttaacgtttccttacggtttacctttaacccgttaaccgtttttcccccg

SEQ ID NO: 400446 - DNA, 534 bp, Homo sapiens
  misc_feature: GZ8MTXP01CNDX6.15.28.C06.1.454.CMB.2.raw
  modified_base (273)..(273): a, c, t, g, unknown or other
  modified_base (436)..(436): a, c, t, g, unknown or other
  modified_base (485)..(485): a, c, t, g, unknown or other
  modified_base (527)..(527): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaaaccagggaaanaccccaaaagtcctgatctctgccgcctctactttgactaaagtcgggggtcccatcaaggttcagccggcaggtggatcgtagggacaagtaattcaagtctacacatcagcagctgcagctagacgtatttgactaacttactacttgggaccctaaggtnactaaataactaagtctaagtttcgggaggacggtaccgaagggtgganatacgaaacgaacgtgttggcttgcaccaatctagttcttcnctttccc

SEQ ID NO: 400447 - DNA, 540 bp, Homo sapiens
  misc_feature: GZ8MTXP01BNW47.15.28.C06.1.454.CMB.2.raw
  modified_base (198)..(198): a, c, t, g, unknown or other
  modified_base (446)..(446): a, c, t, g, unknown or other
  modified_base (518)..(518): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagatattactaaatggttggctggttcagcagaacaggaacacccaaagtcctgatctctcgccgcctctactttgacaaaggtcgggtccagtacgaaggttcaggccggactaggtgatcgtagggacaagaatcagtctacacatcacgcacgctgccaggccctagacgtatttgacctaacttactacgtcgactagtacactaataataacgtntacgtttcgggacgggtacggtacgaaggtggaagataacgaaagtaactggttcgggcttacggctacgtntctgttcttcaacgtttccccg

SEQ ID NO: 400448 - DNA, 658 bp, Homo sapiens
  misc_feature: GZ8MTXP01D8HKE.15.28.C06.1.454.CMB.2.raw
  modified_base (199)..(199): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagagtcaccatcacttgccggcagtcagagtattactaaatggtgctggttcagcagaacaggaaacacccaaaagtcctgatctctgccgcctctactttgacaaaggttcggggtaccagtacaaaggttcacgccggcaggtggactcgtagggacaagaattcagtctacaccatacagcacgcctgaccagtccctagtaacgttatttcgaactaactttacctacgttacgggaccctaaagtacgtaactaaattaaacgtaacttacgttaaaccgggttttcggggaaccgggggtaacggggtaaacccggtaagggggttaaggggaaacgttaaacgtaaaccggttaaaaaccgtaaaccgggttgggttacggggcccttacgggaaccctaacctaacgtttacgtacggtttaactttaaccgttaacgttttccccccg

SEQ ID NO: 400449 - DNA, 575 bp, Homo sapiens
  misc_feature: GZ8MTXP01D3RET.15.28.C06.1.454.CMB.2.raw
  modified_base (292)..(292): a, c, t, g, unknown or other
  modified_base (358)..(358): a, c, t, g, unknown or other
  modified_base (438)..(438): a, c, t, g, unknown or other
  modified_base (551)..(551): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaatggtgctgttcagcagaacaggaaacacccaaagtcctgatctctcgccgcctntactttgacaaagggttcgggtacccagtacgaaggttcaggccggctagtggatcgtagggaacngtaattcaagtctacacatcagacagcctgcagtcctaggacctatttacgacttaacttactactgggacctaaggttnaactaattaaactaatttcgtaacggtttcggggaccgggtaaacggggacctaaaggggttggaacgttaactaacgaaacggtacgtaaggttcggcttacggctaacttnttcttcttaccttcttcgttcccg

SEQ ID NO: 400450 - DNA, 631 bp, Homo sapiens
  misc_feature: GZ8MTXP01ESIAN.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccggcagtcagagtattactaagtggtggctggttcagcaagaaaccgagggaaacgacccaaaagtcctagactctctcgcccgtccttcttactttgacgtaaacggttcggggtacccatacgaaggttcaggtccggacaggtggatcgtagggacaagattcagtctcacatcagcacgctgcagtacctagtacgtatttcgactaacttactactcggacctaaaggtcactaaattaaactaacgttacgtaaggtttccggggaacggggtaacggggtaaccgtaaaggggtaagggtaagttaaacgtaaaccggaaaacggtacggttacggttacgggttccttaccggaacctaaacccgttcttccgttcggttacctttccgttaacctttcccccg

SEQ ID NO: 400451 - DNA, 724 bp, Homo sapiens
  misc_feature: GZ8MTXP01D4GQD.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccggccagtcagtagttattaactaaagtggttacggccgttggtttacagacaacgaaaccgaagggaaacgaccccgaaaagtccctagtactcctactcgccccgtcctcttacgttttcgacgtaaacgggttccgggggtacccagttacgtaaacggttacgacggccggaccgtagggtaggtaacttccgggtaacgggggtaaaccaaggttaaactttaccggtaaacggttccctacccaaaccctattaccgacgaccgaacgtccgtcgaccgacgtcccgtagacgttattttcgacctaaacttactactcggaccgtaaggtactactaaattaaatacgtttacgttaacggttttaccggggtaacggggaacgggtaaacccggtaaaggggtaaggtaaacgttaacgtaaaccgttaaaccgtaaacgttgggacgttccttcggaaccactaacttcgttcgttacttccttaacgtttccccg

SEQ ID NO: 400452 - DNA, 567 bp, Homo sapiens
  misc_feature: GZ8MTXP01A4YC2.15.28.C06.1.454.CMB.2.raw
  modified_base (352)..(352): a, c, t, g, unknown or other
  modified_base (389)..(389): a, c, t, g, unknown or other
  modified_base (502)..(502): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtccctgagctctcctgtgaagcctctggattcaccttgagcactatggatgacttgggtccgccgaggctccgaggggaagggctgggagtggggtcgccaccataacgaaaaagntaggaagtgaacccacgaactagtgtgaaactcgtgngagtggggcctattcacgtctccgagagacgacgaccaagaacctcactacactactagacaaatgaaacaacctagacgacgccgaggacacggtctgtgtattacgtgtgnggagagtatgttcgttggcggttcggggccgtaacgggaccctgggttcctaaccggttctcccg

SEQ ID NO: 400453 - DNA, 635 bp, Homo sapiens
  misc_feature: GZ8MTXP01EWY4L.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagtagtattactaatggtgctgttcagcagaaaccaggaaacacccaaaagtcctgactctactcgccgtcctcttactttgacgtaaacggttcgggtacccagtacgtaaaggttcgagccggcaggtggatcgtagggaacaaggtaattcgacgttctaccaactactacgagaccacgcctagccgagtccctagtacgtactttacgactaacgtttactacgtcggacctaaggtcactaataactaacttcgtaaggtttccgggacgggtaacgggaaccgtaaaggggtggtaaacgttaacgtaaacgaaaacggtacgttacggttacgggccttacggaaccctaaccgtaactttccggttacgttaccttttaaccgttaaccgttttcccccg

SEQ ID NO: 400454 - DNA, 624 bp, Homo sapiens
  misc_feature: GZ8MTXP01DL57E.15.28.C06.1.454.CMB.2.raw
  modified_base (307)..(307): a, c, t, g, unknown or other
  modified_base (337)..(337): a, c, t, g, unknown or other
  modified_base (354)..(354): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtcctgagactctcctgtgaagcctctggattcaccttgagcacttattggatgacttggtccncaggctccaggggaaggggctggagtgggngccacataacaaaaagntaggaaagtgaacacaaacctatgtagaactctggtagagtcggggacctattccacccgtctccctcacgccctacccaaccgaacggggccccagtccggtcccttcccccgtggcccgccccgtcgcctcccgaagggaccgcccacccgtccgaagacgccaacgcggccggccccgttggggcctcggcccgttacgggtcaaaacgggttccttaaccgtttcccggacttaacggtacgaccgttgggaacgccggggtaacg

SEQ ID NO: 400455 - DNA, 754 bp, Homo sapiens
  misc_feature: GZ8MTXP01ERBVM.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccggcagtcagtagtattaactaatggttgctggttcagcaagaacgaggaaacgacccaaaagtcctagactctactcgccgtccttacttacgtttagacgtaaacgggttcggggtaccctaagttacgtaaaggtttcgacggccggacgtaggtaggtacgttcggtaaacgggggaaacctaagggtaaactttaccgaaacggttccctaaccgaaacccgtaagttacccaacgggacctaaacgggccccttagggaccctaacggtaccccgttaggttaaccggtttaacgtttttacgaacccttaaacgttttaacctaaccgtttacgggaacccgttaaaggttaccgtaaacttaaacgttaaaattaacgttacgtttaaacgggtttaccggggaacggggttaaacggggaaaccgtaaaggggtaaggaaacgttaacgttaaacgaaaaccggtacgtgggttacggcttacgaacctaactcgttcgtcgttacctttaaccgttaacgtttccccg

SEQ ID NO: 400456 - DNA, 557 bp, Homo sapiens
  misc_feature: GZ8MTXP01AIFMJ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgacgggccagtcagagtattactaaatggttggctggttcagcagaaaccagggaaagccccaaaagtcctgatctctgccgcctctactttgcaaagtgggggtcccatcaaggttcagccggcagtggatctagggacaagaattcagtctcaccatcagcagcctgcagcctgacgtattttgctaacttactactggaccaagtgactaataaataatctagtttcgggcgggtaacgggaaccgaaagggtgggaagttaagtacgaaaacggaacgttggttcgggcttacggccacccgtaattccgtcggttaccttccgttaacgtttccccg

SEQ ID NO: 400457 - DNA, 561 bp, Homo sapiens
  misc_feature: GZ8MTXP01A8P46.15.28.C06.1.454.CMB.2.raw
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatcgacccagtctccgtccaccctgtctgcatctgtcggagacagagtcaccatcacgttcggccggcagtcagtagtatactaagtggtgctggtcagcaagaacgaggaacacccaaagtcctagactcctcgtcgccgtcctcttacgtttcgacgtaaaggtcgggtaccagtacgaaggttcgaggccggacgaggtgacgtcgtaagggactaagtaatcgagttccacaaccatacagcacggcagcacgtcctagtacgtatttacactaacttacgtactcggaactagtcactaataactatgtacggttcggacgggaggacgagggtaagagagtaacaaacgagtgttcggcttcgaacctactaacttcgtacttctcttcgttcccg

SEQ ID NO: 400458 - DNA, 574 bp, Homo sapiens
  misc_feature: GZ8MTXP01ELX7Q.15.28.C06.1.454.CMB.2.raw
  modified_base (267)..(267): a, c, t, g, unknown or other
  modified_base (368)..(368): a, c, t, g, unknown or other
tcagtctacgtagccacgaccggtgctcgatttagagctcacgtattgggtttgggggggagtcagactcagtcaggacacagcatggacatgagggtccccgctcagctcctggggctcctgctgctctggctccaggtgccaaatgtgacatccagatgaccagtctccgtccaccctgtctgcatctgtcggagacagagtcaccatcacttgccgggccagtcagatattactaaatggtgctgttcagcagaacaggaaacncccaaaagtcctgatctctcgccgcctctacttgacaaagtcgggtaccatcaaggttcagccggcagtgatcgtagggacaagattcagtctcacatcancagctgcagacctagactattttcgactaaacttactactacggactaaggtcaactaattaaactacttacgtacgtttcggggacgggaacgggaccgaaaggggtcggtaaagttaacgttaaacgaaaacggtaaaccgtggttacgggcttacggaaccctacgtaacttcgttgttcctttaaccgttaactttcccccg

SEQ ID NO: 400459 - DNA, 549 bp, Homo sapiens
  misc_feature: GZ8MTXP01BQXFF.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgtcgcctctactttgcaaagtgggtccatcaaggttcagccgcagtgatcgtagggacngaattcagtctcacatcagcagctgcagcctgactatttgactaacttactactcggaccaagtgactaataataatcgtagtttcgggcgggtaagggaccgaagggttcggaagttagtaccgaaaacggaaacgttggttaggcttggaacctacccgtaattccgttgttacctttcgttaactttccccg

SEQ ID NO: 400460 - DNA, 611 bp, Homo sapiens
  misc_feature: GZ8MTXP01DLDG5.15.28.C06.1.454.CMB.2.raw
  modified_base (255)..(255): a, c, t, g, unknown or other
  modified_base (373)..(373): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttnagcagaaacagggaaacacccaaaagtcctgatctctcgcccgccttctactttgactaaagggttcgggggtcccagtactaaaggttcaggccggcaggtggatcgtaaggggacngaattcagtctcacagtcagcagcctgcagcctagtaccgtatttacgactaaacttactacgtcggacctaagtacgactaaattaaactaatacgtaagtttccgggacgggaacgggtaaccgaaggggtaacggtaagttaacgtaaccgttaaaacggtaaacgttggttacgggttccgttacggaacctaactaacgttcctacgtttcctttaacgttaacctttccccg

SEQ ID NO: 400461 - DNA, 653 bp, Homo sapiens
  misc_feature: GZ8MTXP01D2YU6.15.28.C06.1.454.CMB.2.raw
  modified_base (633)..(633): a, c, t, g, unknown or other
  modified_base (639)..(639): a, c, t, g, unknown or other
  modified_base (641)..(643): a, c, t, g, unknown or other
  modified_base (645)..(648): a, c, t, g, unknown or other
  modified_base (650)..(650): a, c, t, g, unknown or other
  modified_base (652)..(652): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaagggctggagtgggtggccaccatacaaaaagatggaagtgacacaacctatgtgaactctgtgatgggccgattcaccgtctccagagacgacgccaagaactcactacatctgacaaatgaacactgagagccgaggacacggctgtgtattactgtgtgagagattgttctggcggttgggggacccgaggggacccctggtccaccggtctcctccacggcctccgaaccgtaacgggccccagtcccggtcctttccccccgtgggcccctccccttggccctacccgacgggacgccacccgtccgaacgacggaccacgacgcccgggcccgttcggggccttcgcccgttcgggggtaaccgaaacggggttaacccttaccgttacccggtccgttaaaccggtaacggtaaaccgttgggtaacgggcccgggggtaacgttcggggaaccgaaaacgggggttcccggaacgttaaagtaggngcgcgngnnngnnnngngng

SEQ ID NO: 400462 - DNA, 694 bp, Homo sapiens
  misc_feature: GZ8MTXP01ACBP3.15.28.C06.1.454.CMB.2.raw
  modified_base (543)..(543): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagacgtcaccatcacgttggccggcagtcagtagtattactaagtggtgctggttcagacaagaaacgagggaaacaccctaaaagtcctagactctcgtcgacccgtccttacgttacgtttcgacgtaaaagggttcgggggtacccctaagtaccgtaaagggtttacgaacggtcccggacgtaggttgggtaacgtacggtaacggggaaacctaaggtaaactttaccgaaacgtcctaccaacctagttacccaggacctaacggccttaacgccgacgtacccgtagtaaccgttattttcgaactaaactttactaacgttcggacctaaggtanactaaattaaactacttgtaacgtttacgggacgggaacgggtaaccgtaaagggtcggaaagttaacgaaaccgttaaacgtaacgtggttacgttcggacgtaaccaccgtaacgttcgtacgttcccttaacgttaaccgtttccccg

SEQ ID NO: 400463 - DNA, 718 bp, Homo sapiens
  misc_feature: GZ8MTXP01B8AU2.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggcagtcagagtattactaaatggttggccgttgtcagacaagaacgaaggaaccaaccctaaacgtcctagactctcgtcgcccgtccttacttacttggaacgtaaacgggttccggggtacctagtacgtaacggttacgacggcccggacgtaggtaggtacgttcgggtaaacggggaacctaaggttaaactttaccgtacgttaccctacccaacctacgtacgacgacgaacgtcccgtacggaccaaccgtaccgttaacggtaacgttttaacgttttaccggaaacctttaaaccgttaaccttaaccgtacggtaaacccgttaaagggttaccaactaaatttaaaacgtaacttacgtttaacgggtttccggggaacgggggtaaccggtaaaccggtaagggtaagggaacttaacgtaaacgaaacgtaaggtcgttacggcttacgaactactaattcgtctttctaacttcgtttccccg

SEQ ID NO: 400464 - DNA, 720 bp, Homo sapiens
  misc_feature: GZ8MTXP01BSJLU.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctggtcgagacagagtcaccatcacgttcggccggccagtcagtagttaattaacgtaaagtggttcggccttggttcagacaagaaaccgaagggaaacacccaaaagtcctagactcctctcgcccgccttactacgtttacgacgtaaaggtcgggtacccagtacgtaaggtcacggccggactaggtggactacgtaagggaactaaggtaaactttcgacgttacctacaacctatacacgcgacgtcctacggacctaaggtcccgtaggtaaccgtttacgttttacgaaccttaaacgtttaactaaccgtacgggtaaccgtaaaggtacgtaacttaaaacttaaattaaaccgttcggttaaacgggtttccggggaaacggggttaaacggggtaaaccgaaaggggtaacggtaaagaacgttaaacgaaacggtaaacgttcgggttaacggttcttaaccggaacctaaacccggttcttcgttacgttaccttaacccgttaaccgtttccccg

SEQ ID NO: 400465 - DNA, 550 bp, Homo sapiens
  misc_feature: GZ8MTXP01CCLS3.15.28.C06.1.454.CMB.2.raw
  modified_base (354)..(354): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaccaggaaagccccaaaagtcctgatctctcgccgcctctactttgcaaagtggggtccatcaaggtcagccggcagtggatcgtagggacngaatcagtctcacatcagcagctgcagcctgacgtattttgactaacttactactcggacctaagtcgactaataataatcgtaatttcggggacgggtaagggacccgaagggtgggaagagtacgaaaacgtaacgtggttacggcttggaacctaccgtaattcttacgttactttccgttaactttcccccg

SEQ ID NO: 400466 - DNA, 539 bp, Homo sapiens
  misc_feature: GZ8MTXP01ANZO2.15.28.C06.1.454.CMB.2.raw
  modified_base (263)..(263): a, c, t, g, unknown or other
  modified_base (358)..(358): a, c, t, g, unknown or other
  modified_base (415)..(415): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatatactaaatggtgctgttcagcagaacaggaanacccaaagtctgatctctcgccgcctctactttgctaaagtcgggtccatcaaggttcaggccggcaggtggatcgtagggacaagaatcagtcncacatcagcagcctgcagcctgacttatttgactaacttactactcggacctaagtnactaataatatctagtttcgggacgggaacggaccgaaggggtcgaaagacgtaacgaaacgtaccgtaggttcggcttcggcctaacctaacgttcgtcgttccttccgttaactttcccccg

SEQ ID NO: 400467 - DNA, 653 bp, Homo sapiens
  misc_feature: GZ8MTXP01AYMJ6.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgaccagtctccgtccacctgtctgcatctgtcggagacagagtcaccatcacgttcgccgggcagtcagtagtattactaagtggtgctgttcagcaagaaacagggaacacccaaagtccagatctctcgccgtcctacttacgttgacgtaaaggttcggggtaccaagttcgtaaaggttcgacggcccggactaggtacggacgtaccggtaaggggaaacctaagggtaaactttaccgacgttaccctacaaccctagtacccgaagaccgaacggtccctagggaccaacggtcccgtaggtaaccggttattttacggaacttaaacccgttacgtaccttacgggacctaaaggtcaactaaataactaactgtacggtttcggacgggtaacggaccgaagggtaacgagttaacgtaacgaaaccggtaacgtggttacggcttcggaactacctaagtcttacgttcctaacgttcgtccc

SEQ ID NO: 400468 - DNA, 762 bp, Homo sapiens
  misc_feature: GZ8MTXP01BMW73.15.28.C06.1.454.CMB.2.raw
  modified_base (198)..(198): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagacgtcaccatcacgtcggccggccagtcagtagttattaactaaagtggttcgctggttcagacaagaaaccgaggaaacacccgaaagtcctagactctcgtcgcccgtccttacttacgtttcgaccgtaaagggtccggggtacccctagttaccgtaaaggttcgaacggtccgggtacagggtaggtacgtcggtaaggggaaacctaaggtaaactttccgaacgttaccctacctaacccattaccgaacgaccgaacggttcccgtacgaccgtacggtaccccgtacggtaaaccgtttatttttaccgaaacccttaaacctttaccgtaaccgtaccgggtaaaccgtaaggttaacctaacctaaaattaaaacctaaacgtttcggtaaaccggttttccggggaaccgggtaaacggggaacccggtaaaggggtaaccggaaaggttaaacgtaaacgaaaacccgggtaacgtgggttaacgggccttacggaaccctaacgtcgtttacggttacttacctttccgttaacctttaacccccg

SEQ ID NO: 400469 - DNA, 527 bp, Homo sapiens
  misc_feature: GZ8MTXP01AWNRD.15.28.C06.1.454.CMB.2.raw
  modified_base (356)..(356): a, c, t, g, unknown or other
  modified_base (415)..(415): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgcctggttcagcagaaaccagggaaagccccaaaagtcctgatctctgccgcctctactttgcaaagtggggtcccatcaaggttcagccggcagtcggatcgtagggacngattcagtctcacatcagcagctgcagctgacgatttagtcaactactactgccagtanatataatatactacgtacggtacggacggacgaaggtaaggaagagtaacgaaacgtaacgtaggttcggttcgttacgaacacgtaacgtctcgttcttaacgttcgtccg

SEQ ID NO: 400470 - DNA, 573 bp, Homo sapiens
  misc_feature: GZ8MTXP01EA3TL.15.28.C06.1.454.CMB.2.raw
  modified_base (197)..(197): a, c, t, g, unknown or other
  modified_base (414)..(414): a, c, t, g, unknown or other
  modified_base (442)..(442): a, c, t, g, unknown or other
  modified_base (551)..(551): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggcagtcagagtattactaaatggttggctggttcagcagaaacagggaaagacccaaaagtcctgatctctcgccgtcctcttactttgacgaaaggtcggggtaccagtcaaaggttcgagccggcagtggatcgtaggggacaaggaattcagtctcacatcagcagcctgcagtcctagtacgtacgtttnactaacttactacgttcgacctaaggtnactaaataaataacttcgtaaacgttttcggggacggtaacgggggaacctaaaggggtaaggaaggactaacgaaacgaaacgtggttaggccttagctaccaattcncgttacttcgaacgtttccccg

SEQ ID NO: 400471 - DNA, 551 bp, Homo sapiens
  misc_feature: GZ8MTXP01A0B61.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggtgctgttcagcagaacaggaaacgacccaaaagtcctgatctctcgccgcctctactttgacgaaaggtcgggtccatcgaaggttcagccggcaggtggatcgtagggacaagtaatcagtctacacatcagcacgcctgcagtcctgacgttatttacgactaacttactactcggacctaaggtcactaattaataactctagtttcgggacgggtaagggaccgaagggtaacggagaataacgaaacgtaacgtggttacggcttacgaacacctaacttcttagttccttcttaacgttccccg

SEQ ID NO: 400472 - DNA, 618 bp, Homo sapiens
  misc_feature: GZ8MTXP01EFU52.15.28.C06.1.454.CMB.2.raw
  modified_base (362)..(362): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccggcagtcagagtattactaaatggttgctggttcagcagaacgaggaaagacccaaagtcctagatctctgccgccttctactttgactaaagggttcgggtcccagtacgaaggttcaggccgcagtggatcgtagggacngtaattcagtctcacctagtcagcagcctggcaggcctgtacgtattttcgactaacttactactcgggaacctaaagttcgactaataaataacttaccgtaagtttccgggacgggtaacggggaaccgaaaggggtggaaagttaacgttaaaccgaaaacggtaaaccgttgggttcggggttacccttaggaaccccgttaaccgtaatttccccggtttagtttaccctttaaccgttaaccgtttcccg

SEQ ID NO: 400473 - DNA, 715 bp, Homo sapiens
  misc_feature: GZ8MTXP01CJECG.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagatcacatcactgccggcagtcagagtattactaagtggtgctggttcagcagaacgaggaacgacccaaagtcctagactctctcgccgtcctacttacttagacgtaaacggtcgggtacccatacgaaggttcgacgccggctaggtgatcgtagggactaagtaattacagtcctacaccgtatacgacgctacggcctacggaccgacgtaccgtacggtacgttacgttttacgaacccttaaacgtttaaccgtaaccgtacgggtaaccccgtaaaggttacgtaacctaaatttaaacgttaaacgttaccgttaaccgggttttaaccgggggaaccgggggtaaacgggggtaacccgggtaaagggggtaaggggtaaacgttaaacgttaaaccgggaaaaccggttaaacggtcggggttaaacggttcccgttacggaacccgtaacccttaacgtttacccgttcgtttaccttaacccgttaacctttaacccccg

SEQ ID NO: 400474 - DNA, 534 bp, Homo sapiens
  misc_feature: GZ8MTXP01CKFBD.15.28.C06.1.454.CMB.2.raw
  modified_base (269)..(269): a, c, t, g, unknown or other
  modified_base (351)..(351): a, c, t, g, unknown or other
  modified_base (514)..(514): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttgcctgttcagcagaacagggaaancccaaaagtcctagatctctgccgctctactttgcaaagtgggtcccagtcaaggttcagtccggcagtgatcgtagggacngaattcagtctcaccatcagcagcctgcagcctagacgtattttgacctaaactttactacttcgggaccctaaaggtcactaataaataatctagtttcgggcggtaagggaccgaagggtggaagagtacaaacgtaacgtgttacggcttggaacacctnttctcgttcttcttcgttcc

SEQ ID NO: 400475 - DNA, 553 bp, Homo sapiens
  misc_feature: GZ8MTXP01ES2LG.15.28.C06.1.454.CMB.2.raw
  modified_base (523)..(523): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttggccgggcagtcagtagtattaactaaagtggttggcctggttcagacaagaaaccgaagggaaacgacccaaaagtcctagatctctcgcccgtccttctactttgactaaagggtcggggtacccatcaaggttcaggccggcgagtggatcggtaagggacaagtaattcagtctacacatcagcacgcctgcagtccgtagtaccgtattttcgactaaacttactactcggacctaaggtcactaataaataatcgtagttcgggaggacggacgaagggtgaagatacgaaacgacgtgnggcttgcactaactctgttctcttcttccc

SEQ ID NO: 400476 - DNA, 621 bp, Homo sapiens
  misc_feature: GZ8MTXP01CM23N.15.28.C06.1.454.CMB.2.raw
  modified_base (259)..(259): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctcccgtccaccctgtctgcatctgtcggagacagagtcaccatcacgttcgccggcagtcagagtattactaagtggtgctgttcagnagaacgaggaacgacccaaagtcctgactctctcgccgtcctcttacttgacgtaaagggttcggggtaccctagtacgaaggttcacggccggacgaggtggatcgtaagggacaagtattcagtctacacctatcacgcgacgccgtgcgacgtccgtagtacgttactttacgaccttaacttacgtacgtcgggtacctaaagtcgaactaattaaagtaacgttcgttaagttccggggacgggaacgggtaaccgtaagggtaaggaacgttaacgtaaacgaaacgtaaacgtggttacggcgttacgtaaccgtaccttaagttcccttgttacccttccgttaactttccccg

SEQ ID NO: 400477 - DNA, 599 bp, Homo sapiens
  misc_feature: GZ8MTXP01BZBEX.15.28.C06.1.454.CMB.2.raw
  modified_base (294)..(294): a, c, t, g, unknown or other
  modified_base (296)..(296): a, c, t, g, unknown or other
  modified_base (391)..(391): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcacatcacttcgccgggcagtcagtagtatactaaagtggttgcctgttcagacagaaccgaggaaacacccaaagtcctagatctcncnccgcctcttactttgactaaaggtcgggtaccagtcaaggttcaaggtccggctagtggatcgtaagggacaagtaattcagtcctacaccctanacacgcgacgcctagccacgtaccgtagtacgttacgtttacgaccttaacttacctacgtacggaactaagtactaactaaattaaattacgtacgtacggttacgggacgggtaacggaacgtaagggtaagtaagaacgtaaacgaaacgtacggtgttacgcttacgaacctactaacgttcgtcgttcttcgttccgttcccg

SEQ ID NO: 400478 - DNA, 770 bp, Homo sapiens
  misc_feature: GZ8MTXP01DAOSP.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagatattactaaatggttgctggttcagcagaacagggaaacgcccaaaagtcctagatctctgcccgtcctcttactttcgactaaacgggttcgggggtacccagttaccgtaaaggggttcacggtcccggccgtaagggtcgggtaacgttccggtaagggggaacctaagggtaaactttacccgaacggtttcctacccgaaccctaacgtccgaacgaccgaacggtcccgtacggaccgaacgtacccgttacggtaaccgtttatttttacggacccttaaacgtttaacctaccgttacggggtaacccgtaaagggtttacgaaaccttaaagttaaaaccgttaaatttacccggttaaacggttttccgggggaaccgggggtaaacggggtaaacccggtaaagggggttaaggaaacggttaaacgttaaccggaaaacggtaaaccgttgggttaaccgggttccttacgggtaaccctaacccgtaagtttcccttacggtttaccctttaaccgaaccttttcccccg

SEQ ID NO: 400479 - DNA, 715 bp, Homo sapiens
  misc_feature: GZ8MTXP01CZ4KD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccggcagtcagagtattactaaagtggtgctgttcagcagaacgaggaaacgacccaaaagtcctagactctctcgcccgtccttacttactttgacgtaaacgggtcgggggtacccctatacgtaacggttcgacggccggtaccgtaggtggtacgtcggttaacggggaaactaaggtaaactttccgaacggttcctaccaaccctataccgacgccgaacggtccctaggacctaacggtccccgttagggtaaccttacgtttttacggaaccttaaacctttaccgttaaccgttacggggtaaccccgtaaaggttacgaaacctttaaagttaaaattaaccgttacgttaaacgggttttaccgggggaacgggggtaaacggggaaccgtaaagggggttaaggaaacgaagttaacgaaacgtaaacgtggttacggcttacggaaccaccgtaattctgttaccttcgttaacgtttccccg

SEQ ID NO: 400480 - DNA, 886 bp, Homo sapiens
  misc_feature: GZ8MTXP01DQW8S.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatctggtcggagacagagtcacatcacgttgccggcagtcagatatactaatggtgctggttcagcaagaacgaggaaacacccaaagtcctgatctctgtcgccttcttacgtttgacgtaaagggttcgggggtcccctagttaccgtaaagggtttccgaacgggtccccggggaccggtagggttacggggtaacgttaccggttaacggggggaaaccttaagggtaaacttttacccggtaaacggttaccccttacccgaaacccctaaagttacccgaacggtccgtaaccggtccccgttcgggaccccgtaaacgggtccccgtttaacgggtaaacccggttttaattttttaccgggaaaccctttaaaacccttttaaacccgttaaaccccgttaacggggggtaaccccttaaaaggggtttaccgaaacccgttaaaatttaaaactttaaacgtttaccggttaaaccggtttttacccggggggaaaccgggggttaaaccgggggtaaacccgggtaaaagggggttaaaccgggaaaggttaaaccggttaaacccggttaaaaaacgggttaaacgtttcggggttaaccgggttccgttaccgggaaccctaaacccgttaacggtttacccttcggtttacccgttttaaccgttaacccctttttaacccccgg

SEQ ID NO: 400481 - DNA, 544 bp, Homo sapiens
  misc_feature: GZ8MTXP01C693A.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccggcagtcagatatactaaatggttgctggttcagcaagaacaggaaacacccaaagtcctgatctctcgccgccttctactttgactaaggtcgggtccatcgaaggttcaggccggctaggtggatcgtagggacaagtattcagtctacacatcagcagcctgcagccctagacgttatttagacctaaacttactactggggacctaaggtcactaataactatcgtaagttcgggacgggagggaaccgtaagggaacgaagataacgaaacgtacttgggagccttagcctactcttactcttaccttcgctttccccg

SEQ ID NO: 400482 - DNA, 586 bp, Homo sapiens
  misc_feature: GZ8MTXP01CY25W.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagagtcacatcacttgccggcagtcagatattactaaatggtgctgttcagcagaacgaggaaacacccaaagtcctgatctctcgccgtcctcttacttcgacgtaaagggttcggggtacccagtacgtaaggttcgacggcccggctaggtggactcggtaagggaacaaggtaacttcagtctaccactatcagcacgcctgcacgctagtacgttatttcgactaacttactacgtcggaccaagtcactaattaataagtcgtaacgttcgggacgggtacggaaccgtaagggtaaggaagaacgtaacgaaacgtaacgtggttacggttcttacgaacctaccgtaattcctgttacctttaaccgctttccccg

SEQ ID NO: 400483 - DNA, 609 bp, Homo sapiens
  misc_feature: GZ8MTXP01E1OL8.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaatggtgctggttcagcaagaacagggaaacacccaaagtcctgatctctcgccgcctctactttgacgtaaaggtcggggtcccatcgaaggttcacggccggcaggtggatcgtagggacaagaatcacgtctacaccatcagcacgcctgaccacgtccctaggtaacgttacttttacgaccttaaacttactactcgggactaagtgactaataaataactcgtaacggtttcgggacggggtaacgggtaaccgaaagggtaagggtaacgaacgtaaacgaaaacggtaaaccggttggttacgggttcttcggaaccctacctaacgtttcgttacggttacctttaaccgttcctttaaccccg

SEQ ID NO: 400484 - DNA, 560 bp, Homo sapiens
  misc_feature: GZ8MTXP01BBTAZ.15.28.C06.1.454.CMB.2.raw
  modified_base (354)..(354): a, c, t, g, unknown or other
  modified_base (423)..(423): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggctggttcagcagaaacaggaaacgacccaaagtcctagatctctcgccgtcctctacttgacaaagtcggggtccatcaagttcagccggcagtgatcgtagggacngattcagtctcaccatcagcagctgcacgcctagacgtatttcgactaacttactacgtgaccaaggtnactaataaataactacgtacgtttacgggcgggtaagggtaccgaaagggtcggaaaggaacttaacgaaaacgtaacgtggttacgggcttacggaaccaccgtaattcgtacgttcttccgttaacgtttccccg

SEQ ID NO: 400485 - DNA, 563 bp, Homo sapiens
  misc_feature: GZ8MTXP01B105A.15.28.C06.1.454.CMB.2.raw
  modified_base (199)..(199): a, c, t, g, unknown or other
  modified_base (452)..(452): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggcagtcagagtattactaaatggttggctggttcagcagaacagggaaacgcccaaaagtcctagatctctcgccgcctctactttgactaaaggtcggggtacccagtacgaaggttcaacgccggctaggtcggaatccgtagggaactaaggaaatttcagtctacaccatccagcagcctagcagcctagactatttcgactaacttactactgggacctaaggtnactaataataactctacgtttcgggacgggaacgggaccaagggtggaagagtaacaaacgaacgtggttacggcttagccacaattcctgttaccttcgaacgtttcccg

SEQ ID NO: 400486 - DNA, 587 bp, Homo sapiens
  misc_feature: GZ8MTXP01BCGVE.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaagtggtggctgttcagcagaacaggaaacgacccaaagtcctgatctctcgccgcctctactttgactaaaggtcgggtaccatcgaaggttcaggccggacaggtggatcgtagggacaagtaattcagtcctcaccatcagcagcctgcacgccgtagtacgtatttcgactaacttactacgtcggacctaaggtcactaattaattaactcgtaaggtttcgggacgggtaacggggtaaccgaaggggtggaacgttactaaaccgaaacggtaaacgtggttcgggccttcggaaccctacctaacgtttccgttcgttacctttccgttaactttccccg

SEQ ID NO: 400487 - DNA, 558 bp, Homo sapiens
  misc_feature: GZ8MTXP01BM2I0.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgcctggttcagcagaacaggaaacgacccaaaagtcctgatctctcgccgcctcttactttcgacgaaaggtcggggtaccagtcaaggttcaggccggcagtggatcgtagggacaagaattcagtctacacatcagcagcctgcagcctgtacgtatttcgactaacttactacgtcgacctaagtgactaataaagtatacgtagtttcggacggtagggacgaagggtggaagaatacgaaaacgtaacgtggttacggttcttacggaacctactaacttcgttacgttccttcgttaactttccccg

SEQ ID NO: 400488 - DNA, 570 bp, Homo sapiens
  misc_feature: GZ8MTXP01AJ6U0.15.28.C06.1.454.CMB.2.raw
  modified_base (266)..(266): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggtgctggttcagcagaacaggaanacccaaagtcctgatctctcgccgcctctactttgcaaagtcggggtccatcaaggttcagccggcaggtgatcgtagggacaagaatcagtctcacatcagcagcctgcagcctgtacgtattttcgactaacttactactacgggacctaaggtctactaattaaataactccgtagtttaccggggcgggaacgggaaccgtaaggggtaaggaagttaacgtaacgaaacggtaaacgtggttcggaccttcggaaccaacctcttccgtacggtttcccttaacgttaacgtttccccg

SEQ ID NO: 400489 - DNA, 573 bp, Homo sapiens
  misc_feature: GZ8MTXP01D6FZ7.15.28.C06.1.454.CMB.2.raw
  modified_base (198)..(198): a, c, t, g, unknown or other
  modified_base (357)..(357): a, c, t, g, unknown or other
  modified_base (427)..(427): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtattactaaatggtgctggttcagcagaacagggaaacacccaaaagtcctagatctctcgccgtcctctactttgactaaaggtcgggtcccatcgaaggttcagccggcagtgatcgtagggacngaattcagtctacacatcagcagcctgcagcctgtacgtatttcgactaacttactactggacctaagtnactaataaataactcgtaagtttcgggacgggtaacgggtaaccgaaaggggttaagaacggaattaacgaaaacggtaaacgttgggttcggcttacgggaacctacctaacgtttctacgttcctttccgttaacgtttccccg

SEQ ID NO: 400490 - DNA, 584 bp, Homo sapiens
  misc_feature: GZ8MTXP01BWAYR.15.28.C06.1.454.CMB.2.raw
  modified_base (270)..(270): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgctggttcagcagaacagggaaacncccaaaagtcctgatctctcgccgcctctactttgacaaaggtcggggtccagtcaaggttcagccggcagtggatcgtagggacaagaattcagtctacacatcagcagctgcagtcctagtacgtatttcgactaaacttactaatcgggtaccctaagttcgactaattaaactaatcgtaacgtttcgggacggggaagggtaaccgaaggggtggaagttagttaaccgaaaacggtaacgtggttacgggcttacggaacctacccgtaattccgttacggttacctttccgttaacgttttcccccg

SEQ ID NO: 400491 - DNA, 722 bp, Homo sapiens
  misc_feature: GZ8MTXP01DO3J6.15.28.C06.1.454.CMB.2.raw
  modified_base (265)..(265): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagatcaccatcacttgccggcagtcagatatactaagtggtgctgttcagcagaacgaggaaacncccaaagtccagactctctcgccgtccttcttactttgacgtaaacggttcggggtacctagtcgtaaggttcgacggcccggactaggtacggtacgtcgtaacggggaactaaggtaacttcgacgttcctacaccgtatacgacgcacgtaccgtgaccgtacgtacccgttaggtacgttagttttacggaaccttaaaccgtttaacctaaccgttacggggtaaccctaaagggttactaaccgttaaagttaaaacttaacgttaccgttaaacggttttccgggggaaccggggttaaacggggaacccggtaaacgggggtaacgggtaaagttaacgttaaacccggttaaaagttaaaccgggttggttacggttaccgttacggaacccgttaaacgttcgttaccctttacggttacctttaaccccgttaacttttcccccgg

SEQ ID NO: 400492 - DNA, 512 bp, Homo sapiens
  misc_feature: GZ8MTXP01AO9DM.15.28.C06.1.454.CMB.2.raw
  modified_base (354)..(354): a, c, t, g, unknown or other
  modified_base (429)..(429): a, c, t, g, unknown or other
  modified_base (507)..(507): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaccagggaaagccccaaaagtcctgatctctgccgcctctactttgcaaagtggggtcccatcaaggttcagccggcagtggatcgtagggacngaattcagtctcaccatcagcaggcctagcagccctgacgtattttcgactaacttactaactgaccgtaaagtnactaataaataatctaagttcggcggaaggaccaagggtcgagatacgaaacgatgttgcttgcacaatctgttctcnttccc

SEQ ID NO: 400493 - DNA, 635 bp, Homo sapiens
  misc_feature: GZ8MTXP01C12V4.15.28.C06.1.454.CMB.2.raw
  modified_base (244)..(244): a, c, t, g, unknown or other
  modified_base (247)..(247): a, c, t, g, unknown or other
  modified_base (395)..(395): a, c, t, g, unknown or other
  modified_base (400)..(400): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtctccgtccaccctgtctgcatctgtcggagacagagtcacatcactgccggcagtcagagtatactaatgtgctgtnagnagaacaggaacacccaaagtctgactctctcgccgtccgttctacgtttcgacgtaaacggttcgggaccctagtacgtaaggttcgaggccggactaggtggagtcgtaagggaactaaggtaacttcgtagtcctacacactcgancgacncgtgactacgctacgtacgttatttcaacttaacttactacgtacgtaccgtaagttcaactaaattaaattaacgttacgttaaacggtttccggggtaaggggaaaccgggtaaaccgtaaggggtaaggaaacgttagtaaaccgttaaacgtaaaccggttggttacgggaccttaacggccctaaaccgttcgttccgttacgtttaccttaaccgttaaccgttccccg

SEQ ID NO: 400494 - DNA, 651 bp, Homo sapiens
  misc_feature: GZ8MTXP01ECSAE.15.28.C06.1.454.CMB.2.raw
  modified_base (198)..(198): a, c, t, g, unknown or other
  modified_base (249)..(249): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccggcagtcagtagtatactaagtggtgctgtnagcagaacaggaaacacccaaagtcctgatctctcgccgtccttacttactttgacgtaaacggttcgggtaccagttacgaaggttcaggccggcgaggtggtatcgtaagggaacaagtaacttcgacgtctaccactatcagcacgtccgtgaccgacgtcccgttagtaacgttacgttttacgaaccttaaactttaccttaaccgtacgggtaacccgtaaagttcgtaactaaattaaacttaacgttacgttaacgggtttccggggaacggggtaacggggtaaaccgtaaggggtaaggtaaagttaacgtaaaccgaaaacggtacgttcgggttacggcgttacgaacctaacgtcttccgtcgttacctttaaccgttaactttccccg

SEQ ID NO: 400495 - DNA, 613 bp, Homo sapiens
  misc_feature: GZ8MTXP01DR0KX.15.28.C06.1.454.CMB.2.raw
  modified_base (478)..(478): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgaccagtctccgtccaccctgtctgcatctgtcggagacagagtcaccatcacttgccggcagtcagtagtattactaaagtggttggctggttcagcaagaaaccgagggaaacgacccaaaagtcctagactctctacgccgccttcttacgtttgacgtaaaggtcgggtaccagtacgtaaggttcgaggtccggacgtaggtggatcgtaagggactaaggaattcgacgtctaccactataccagacacgcctggacacgcctaggtacttagtttacgacctaacttactacttacgggaacctaaggtanaactaataaactaagtctaacgttcgggacggtaacgggaacgtaagggtaaggaacgaagttaacgaaacgtaacgtggttacgttcgttacgaactacctaagttcctagttccttccgttaacgtttccccg

SEQ ID NO: 400496 - DNA, 646 bp, Homo sapiens
  misc_feature: GZ8MTXP01CDBUE.15.28.C06.1.454.CMB.2.raw
  modified_base (267)..(267): a, c, t, g, unknown or other
  modified_base (399)..(399): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcactcgccggcagtcagagtattactaagtggttgctggttcagcagaacaggaacncccaaagtcctgatctctcgcccgccttactactttagacgtaaaggtcggggtaccagtacgaaggttcaggccggcagtggatcgtaagggactaagacttcgagtctacactataccagacacggtccngaccacgtcgtacgtaacgttattttacgacttaaaccttacgtacgttacggaccgtaaagttgaacctaaattaaactaacgttaccgttaacgggtttacggggacggggtaacggggaaccgtaaagggggttgggaaacgttaaacgtaaaccgttaaaacggtacgttagggttcgggttccttacgaaccgtaccccttaagttcccgttacggttacctttccgttaacttttcccccg

SEQ ID NO: 400497 - DNA, 622 bp, Homo sapiens
  misc_feature: GZ8MTXP01CH65V.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccaccctgtctgcatctgtcggagacagagtcaccatcacttggccggcagtcagagtattactaaatggttgctggttcagacaagaaaccgagggaaacacccaaaagtcctgactctctcgcccgtccttactacgtttcgacgtaaacgggttcggggtacccctattaccgaacggttcgaacggcccggacgtaggtcgggactcggtaaggggaacaagtaacttcgaacgtcctacaccatcaacgcaacggcctggacacgtaccgtagtaacgttattttacgaaccttaaacttacacccttaggggaccctaaaggtctaactaattaaactacgtacgttacgttacgggacgggtaacggaaccggtaagggtaaggaagaactaacgttaaaccgagtgacggcttagcacgtaatctcttactcgcttaacccg

SEQ ID NO: 400498 - DNA, 874 bp, Homo sapiens
  misc_feature: GZ8MTXP01CWKJJ.15.28.C06.1.454.CMB.2.raw
tcagtctacgtagccacgaccggtgctcgatttagagctcacgtattgggtttgggggagtcagaatcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttggccgggcagtcagagtattactaaagtggtgctggttcagcagaaccagggaaacacccaaaagtcctgatctctcgccgccttcttactttgacgtaaaggttcgggggtacccctagttaccgaaacgggtttcgaacgggtccccgggaccgtaaagggttcggggaaacgtttccgggtaaacggggggtaaacctaacgggttaaaacgttttacccggtaaacgggtttaccccgttaccccgaaaccccttaagtttaccccgaaacggcccgtaaaccgggtcccccgttacgggacccgtaaaccgggtccccgtttacgggtaaacccggggtttaactttttttaccgggaaaccctttaaaacccgttttaaccctttaaaccccgttacgggggtaacccccgttaaaaggggtttacgtaaaccccttaaaagtttaaaaccgttaaaccgtttaccggttaaaccggtttttacccggggggaaaccgggggtaaacgggggtaaacccggtaaagggggttaacgggaaacgttaaacggttaaccgaaaacgggtaaaccgttgggttacgggttccgttacgggaaccctaaacgtctttccgttacggttacctttaaccgttaaccttttcccccgg

SEQ ID NO: 400499 - DNA, 529 bp, Homo sapiens
  misc_feature: GZ8MTXP01DH14M.15.28.C06.1.454.CMB.2.raw
  modified_base (268)..(268): a, c, t, g, unknown or other
  modified_base (378)..(378): a, c, t, g, unknown or other
  modified_base (512)..(512): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggccagtcagagtatactaaatggttgctggttcagcagaacaggaaanacccaaaagtcctgatctctcgccgcctctactttgcaaaggttgggtcccatcaaggttcaggtccggcagtggaatcgtagggacaaggtaattcagtctcacatcancagcctgcagcctgacgtatttcgactaacttactactggaccaaggtcactaataatatcgtagtttcgggacggtagggaaccagggtaaggaagatacgaaacgtactgttacggcttgcacctaatcgtnttcttcaactttccccg

SEQ ID NO: 400500 - DNA, 610 bp, Homo sapiens
  misc_feature: GZ8MTXP01CX3LC.15.28.C06.1.454.CMB.2.raw
  modified_base (252)..(252): a, c, t, g, unknown or other
  modified_base (265)..(265): a, c, t, g, unknown or other
  modified_base (275)..(275): a, c, t, g, unknown or other
  modified_base (286)..(286): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggtgctggttcancagaacaggaacncccaaagtcngatctctgccnctctacttgactaaaggtcgggtcccatacgaaacggttcacggccggacaggtggactcgtaagggaacaagtaattcaagtcctacaccatcagcagcctgcagctgactatttcgactaacttactactagacctaaagtcgaactaattaaataactacgttaacggttccggggaacggtaacggggtaaccgtaaaggggtaagggaaacgttaacgtaaaccgttaaaacggtaaaccgtgggttaacgggccttacgggtaacccaaccttaacggttccgttacgtttaccttaacccgttaaccttttcccccg

SEQ ID NO: 400501 - DNA, 693 bp, Homo sapiens
  misc_feature: GZ8MTXP01CFS3K.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccacctgtctgcatctgtcgganacagagtcacatcacttggccggccagtcagagttattactaaatggtcgctggttcagcaagaaaccgagggaaacgacccaaaagtcctagactctctcgccgtccttctacgtttcgacgtaaaggtcgggtaccctagtacgtaaggtcagccggacgagtcggatcgtaagggaactaagtaaacttcgacgtcctacaacccatacgacgcgaagtcccgtaggcctaacggtccctaggtaacgtttaacggtttacgaaccttaaacccgtttactaacccgttacggaacccgtaaaggttcgaaaccgttaaattaaacttaaacgtacgttaacggggtttaccgggacgggggtaaacgggaaccgtaaaggggtaacgggaaagttaacgtaaaccgaaaacgggtaaacgttgttaccggggttcttacggaaccctacgtaacgttacttcggttacctttaaccgttcctttaaccccgg

SEQ ID NO: 400502 - DNA, 634 bp, Homo sapiens
  misc_feature: GZ8MTXP01ER7GN.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagatattactaaatggtgctggttcagcagaaacagggaaacacccaaaagtcctagactctactcgccgtccttcttactttgacgtaaaacgggttcggggtacccaagttaccgaaaggttcaaggcccggactaggtggatccgtaaggggactaagaaattcagtctacaccatacagcagctagcagtcctagacgttattttagacctaaactttaactaccgttacggaacccgtaaaggttacgaactaaattaaattaaacttacgtaacggttttaccggggaccggggtaaaggggaacccgaaaggggttaagaaaggacttaaacgaaaacggtaaacgtggttcgggcttcgaaccacctaattaccgttcttaccttcgttaacgttcccg

SEQ ID NO: 400503 - DNA, 644 bp, Homo sapiens
  misc_feature: GZ8MTXP01BOVAO.15.28.C06.1.454.CMB.2.raw
  modified_base (365)..(365): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaagtggttggctggttcagcaagaaaccagggaaacgaccccaaaagtcctagatctctcgcccgcctctactttgacaaaggtcggggtccatcgaaggttcaggccggcagtgatcgtagggacngaattcagtctacacatcagcagcctggcacgcctagtacgtattttacgactaactttaactaccgtaggaccctaaaggtactactaaattaaacttaaacttacgttaaacggttttccggggaacgggggtaacgggtaacccgtaaagggggttaaggaaacggttaaacgttaaaccgaaaaaccggtaaccgttagggttacgggccgttacggaaccctaaccgaactttcccgttacggtttaccctttaacgttaaccgttttcccccg

SEQ ID NO: 400504 - DNA, 625 bp, Homo sapiens
  misc_feature: GZ8MTXP01C7K6F.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagagtcaccatcacttcgccggcagtcagagtattactaaatggtgctggttcagcaagaacgaagggaaacgacccaaagtcctagactctctcgcccgtccttcttactttgactaaagggttcgggtacccagttacgaaggttcacggtcccggacgaggtggatcggtaagggaacaagtaattccgagttcctaccaactatcagcacggcctgcacgtcctaggacttagtttacactaacttacgtactagggaccctaaaggtacactaaataaacttaacgttacgttacggtttccgggaacgggtaacggggaaccgtaaagggtaagggaaacgaaacgttacgaaaacgttacggtgttcggcgttctaacaaccgtcgttactcgttaccttcgttaaccgtttcccg

SEQ ID NO: 400505 - DNA, 541 bp, Homo sapiens
  misc_feature: GZ8MTXP01ADXJ2.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcaagaaaccagggaaacgaccccaaaagtcctgatctctcgccgcctctactttgcgtaaagtcgggggtcccatcaaaggttcagccggcagtggatcgtagggacaagaaattcagtcctacacatcagcaggcctagcagcctgacgtattttcgactaacttacgtactaggggccaaagtgactaataaataatctagtttcggcggggacggaccgtaagggtggagagtacgaaacgaactggaggcttgccacaatctgttctcaacgtttccc

SEQ ID NO: 400506 - DNA, 543 bp, Homo sapiens
  misc_feature: GZ8MTXP01ET1OT.15.28.C06.1.454.CMB.2.raw
  modified_base (528)..(528): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggtgctggttcagcagaacaggaaacacccaaagtcctgatctctcgccgcctctactttgactaaaggtggggtaccatacgaaaggttcagccggcaggtgatcgtaagggaacaaggtaatttcgagtctacacatcagcagcctgcagacctgtacgtatttcgactaaacttactactcgactaaggtcactaataaactattactagttcgggacgggaaggaccgtaagggaacgaagttataacgaaacggtaactgttaggcttcgaacacctaatctnttacttcaacttccc

SEQ ID NO: 400507 - DNA, 602 bp, Homo sapiens
  misc_feature: GZ8MTXP01B1OZZ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcactgccggcagtcagagtattactaaagtggttgctggttcagcaagaacaggaaacacccaaagtcctagatctctcgccgtctcttactttgacgtaaaggtcgggtaccagtacgaaggttcaggccggcgagtggatcgtagggacaagtatcacgtctcgacctagcacgcacgctgcacgtaccgtacgtacgtagtttacgtactaacttactactacggacctaagtagtactaataaagtaacttcgtaaaacgtttcgggtaacgggtaacggaaccgtaaagggtaaggaacgttaacgtaacgaaacgtaacgtggttacggttcgttacgaaccgtaccgtaacgttcctacgttccttaaccgttaacgtttccccg

SEQ ID NO: 400508 - DNA, 568 bp, Homo sapiens
  misc_feature: GZ8MTXP01DM6VC.15.28.C06.1.454.CMB.2.raw
  modified_base (197)..(197): a, c, t, g, unknown or other
  modified_base (245)..(245): a, c, t, g, unknown or other
  modified_base (248)..(248): a, c, t, g, unknown or other
  modified_base (259)..(259): a, c, t, g, unknown or other
  modified_base (265)..(265): a, c, t, g, unknown or other
  modified_base (268)..(270): a, c, t, g, unknown or other
  modified_base (272)..(273): a, c, t, g, unknown or other
  modified_base (275)..(275): a, c, t, g, unknown or other
  modified_base (278)..(278): a, c, t, g, unknown or other
  modified_base (280)..(280): a, c, t, g, unknown or other
  modified_base (282)..(282): a, c, t, g, unknown or other
  modified_base (284)..(284): a, c, t, g, unknown or other
  modified_base (300)..(300): a, c, t, g, unknown or other
  modified_base (351)..(351): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcgganacagagtcacatcactggccggcagtcagtatatataatggtgctgtnagnagaacagaacnccaaancannncnncnctntntnanaagtggccatctagtnagcgcagtgatcgtaagggacaagaatcgagtctacacatcagtcacgtcngactacgaccgtagtaacgttatttacgaccttaaacttactaacgtacggggactaaaggtcaaactaattaaatactacgttaacggttcgggaacgggtaacgggtaaacgaaggggttaacgaaacgttaacgtaaaccgaaaacgtacgtacggttcggttcttacggaacctaactcttacgtcgtttacctaaccttaaccgtttccccg

SEQ ID NO: 400509 - DNA, 696 bp, Homo sapiens
  misc_feature: GZ8MTXP01DP29V.15.28.C06.1.454.CMB.2.raw
  modified_base (200)..(200): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatcgtgtcgganacagagtcaccatcactggccggcagtcagtagtattactaaagtggtgctgttcagcaagaacaggaacacccgaaagtcctgactctctcgccgtccttctactttcgacgtaaaggtcgggtacctagtacgtaaggttcgacggtccggacgtaggtcggtaacgttccggtaacgggggaactaaggtaactttaccgaacgttaccctaccgaaccctagttacccgacggaccaacggtcccgtagaccgtacggtaccgttacggtaacgtttacttttaaccgaacctttaaaccttacgttaaccgtaacggtacccgtaaaggtcgtaaactaaatttaaaactaacgttacgttaacgggtttaccgggaacgggtaacgggaaccgtaaggggtaacgaagttaacgtaaaccgaaacgtagtacggttggaccgttactaacccgactaacgttcttcgttaccttcgttaacctttccccg

SEQ ID NO: 400510 - DNA, 628 bp, Homo sapiens
  misc_feature: GZ8MTXP01BQYTQ.15.28.C06.1.454.CMB.2.raw
  modified_base (197)..(197): a, c, t, g, unknown or other
  modified_base (609)..(609): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttggccggcagtcagagtattactaaagtggttggctggttcagcagaaaccgaggaaacgacccaaagtctagatctcgtcgccgcctctacttgactaaaggtcgggtacccagtacgtaaggttcaacggccggctaggtggacgtcggtaacgggaactaagtaaactcgacgtcctaccacccgtatacaacggcaagtccctggacctacgtccctagtacgttatttcgaactaacttactacgtaggaaccgtaagttacgactaaataaacttaacgttacgtaacggttacgggaccgggtaaacgggtaaccgaaaggggtaacggaaagttaacgtaaaccgaaaacggtacgttaggcgttcgttacgaactaccctaagtctnttacctcgttaacttcccg

SEQ ID NO: 400511 - DNA, 620 bp, Homo sapiens
  misc_feature: GZ8MTXP01CVSKN.15.28.C06.1.454.CMB.2.raw
  modified_base (195)..(195): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagttgacccagtctccgtccacctgtctgcatctgtcganacagagtcaccatcacgttgccggcagtcaagagtatactaatggtgctgtcagcagaacaggaacaccaaagtcagatctctgccgtctctacttgacgtaaaggtcgggtacccagtacgaaggttcacggcggaccaggtaggatcgtagggaacaagtaacttcagtctacaccgatcagcagctagcagcctagtactagtttacactaaacttactactacggacctaaggttacaactaaattaaactaacgttacgtacggtttacggggaacgggtaaacgggtaaccgtaaaggggtacggaaacgtaacgttaaaccggtaaacgttacggttacggtacggttaccgttacgaccgtaaccgttacgtttcgttaccgtttaccttaccgttaacccgttccccgtaaccccg

SEQ ID NO: 400512 - DNA, 556 bp, Homo sapiens
  misc_feature: GZ8MTXP01EX22E.15.28.C06.1.454.CMB.2.raw
  modified_base (396)..(396): a, c, t, g, unknown or other
  modified_base (535)..(535): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgctggttcagcaagaaaccagggaaacgaccccaaaagtcctagatctctcgccgcctcttactttgacgtaaagtcggggtaccagtcaaaggttcaagccggcagtggatcgtagggacaagaattcagtctacacatcagcagccngcacgactagtactatttacgactaacttacactacggactaagtgaactaaataaagtactacgtacgttacgggacgggtaagggaacgtaagggaaggaattagtaaacgaaacgacgtggcgcttcgaactactnttcgtcttcttcttcgtcccg

SEQ ID NO: 400513 - DNA, 803 bp, Homo sapiens
  misc_feature: GZ8MTXP01CP084.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagacgtcaccatcacgttgccggcagtcagatattactaatggtgctggttcagcagaaaccgaggaaacacccaaagtcctagactctctcgcccgtccttcttacgtttgacgtaaacgggttcgggggtacccctagttaccgtaaagggttccgaaggtccccgggacgtagggttcgggaacgttccggtaagggggaacctaaggtaaactttcgaacggttcctaccgaacctacgtacgacgcctaacggcccgttgaccgtaacggtcccgttaaggtaccggtttaactttttacggaacctttaaacctttaccgttaaccgttacggggaaccccgttaaaggggttaccgtaaaccgttaaaacgtttaaaagttaaaccgtttaccggttaaaacgggttttcccgggggaaaccggggttaaacgggggaaacccggtaaagggggtaacgggtaaaggttaaaccgtttaaacccggaaaacggttaaacccggtgggtttaacgggcctttaccgggaacccgtaacccttaacggtttacccgttccggtttaccctttaacccgttaaccgttttccccccg

SEQ ID NO: 400514 - DNA, 571 bp, Homo sapiens
  misc_feature: GZ8MTXP01DS990.15.28.C06.1.454.CMB.2.raw
  modified_base (200)..(200): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctggtcgganacagagtcacatcacttgccggcagtcagagtattactaatggtgctggttcagcaagaacgaggaaacacccaaagtcctgatctctcgccgtccttctactttgacgtaaacgggttcggggtaccctagtacgtaaaggttcacggccggctaggtggactcgtaagggaactaagtaatcagtctacacatcagcagcctgcagcctagtacgtatttcgactaacttactactggactaaagtcaactaataaataattcgtaagtttcgggagggtaacgggaccgtaaggggtaagaacgttagtaacgaaacggtaacgtggttacggcttagccactaagtctcgttcttcaacgtttcccg

SEQ ID NO: 400515 - DNA, 566 bp, Homo sapiens
  misc_feature: GZ8MTXP01A2CAK.15.28.C06.1.454.CMB.2.raw
  modified_base (364)..(364): a, c, t, g, unknown or other
  modified_base (373)..(373): a, c, t, g, unknown or other
  modified_base (535)..(535): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttgcctgttcagcagaaacaggaaacacccaaaagtctgatctctcgccgtcctctacttgacaagtcgggtccatcgaaggttcaggccgcagtggatcgagggacaagtattcgacgtcnctacatcancacgcctgcagccgtagtacgtatttcgactaacttactaactcggacctaaggtcactaataataactacgtagtttcggggacgggtaacgggaaccgtaagggtaacgaagttagtacgaaacggtaaacgtggacggttcgttacggaactaaccctnttctacgttccttaaccgttaactttccccg

SEQ ID NO: 400516 - DNA, 613 bp, Homo sapiens
  misc_feature: GZ8MTXP01CGDSC.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacgttgccggcagtcagagtattactaagtggtgctgttcagcagaacgaggaaacacccaaagtcctagatctctcgcccgtcctcttacgtttgacgtaaaggttcgggggtaccctatcgtaaaggttcgacgccggcaggtggatcgtaagggacaagatcagtctcacatcagcagcctgcacgtcctagtacgttatttacgactaacgttactactacgggacctaaggtcaactaaattaaactaacgttcgtaacggtttccgggacgggtaacgggaacccggtaagggtaacggaaagttacgtaaaccgaaacggtaaacgttgggttacggttccttacggtaaccctaccgtcttaccgttcgtttaccttccgttaacttttcccccg

SEQ ID NO: 400517 - DNA, 535 bp, Homo sapiens
  misc_feature: GZ8MTXP01A7UZD.15.28.C06.1.454.CMB.2.raw
  modified_base (357)..(357): a, c, t, g, unknown or other
  modified_base (386)..(386): a, c, t, g, unknown or other
  modified_base (528)..(528): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaagtgggtccatcaaggttcagccggcagtggatcgtagggacngaaatcagtctcaccatcagcagcctgcngaaaccctgtacgtattttcgactaacttactactggacctaagtgactaattaaataattctaagtttcgggacgggaagggaccaaagggtggaagatacgaaacgacgtgttaggcttgaacaccaattctgttcttcncttcccg

SEQ ID NO: 400518 - DNA, 586 bp, Homo sapiens
  misc_feature: GZ8MTXP01BKEQ2.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtgctgttcagcagaaacaggaaacgacccaaaagtcctgactctctcgcccgtcctacttaactttcggacgtaaaacgggttcgggggtaccccagttaccgtaaacggttcgaaggtcccgggacgtaggtcgggtattccgtaaggggaactaaggtaaactttcgaacgtcctacaccatacagcacgctgcagcctagacgtatttcgactaacttactactcggactaagtcactaataactatctagttcggacgggtaggaacgtaaggtaaggaacaagtaaccgaaagaagtggacggcttcgaactacctaattctcgttctcttaacgttccc

SEQ ID NO: 400519 - DNA, 683 bp, Homo sapiens
  misc_feature: GZ8MTXP01DAK0R.15.28.C06.1.454.CMB.2.raw
  modified_base (457)..(457): a, c, t, g, unknown or other
  modified_base (468)..(468): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtcctcccgtccaccctgtctgcatcgtgtcggagacagagtcaccatcacgttcggccggcagtcagagtattactaagtggttggtctgttcagacaagaaaccgagggaaacacccgaaaagtcctagactctcgtcgcccgtccttcttacgtttcggacgtaaacgggttcgggggtaccctagttacgtaaacgggttcgacggtcccggacgtaggtagggacgtaccggttaaggggaactaagggtaaactttccgaacggttacctaccgaacctatcgacncgaacgtccgngaccgacgtaccttggtaaccgttatttacgaccttaacttacgtacttaggacctaaaggtacactaattaaacttagtacgttaggttccgggaacggggaacggtaccgaagggtaacggaagttacgtaaacgaaacggtaacgtgttaacgggttcttacggaacctaaaccgtttcgttcgttactttaccttaaccttcccgttcccg

SEQ ID NO: 400520 - DNA, 666 bp, Homo sapiens
  misc_feature: GZ8MTXP01ERSA3.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatcgtggtcggagacagagtcaccatcacttgccggcagtcagagtattactaaatggtgctggttcagcagaacaggaaacgacccaaaagtcctgatctctcgccgtcctcttactttgacgtaaacgggttcgggggtaccccagttacgaaaggttcgaggccggacgaggttggatcgtaaggggaactaaggtaaactttcgaacgttcctaccaaccctataccgaagccaagcccgtcgaccaggtaccctggtaaccgtattttcgacctaaactttactactacggggtacctaaaggtacaactaaattaaataacgttacgtaacggttttccggggacggggtaaacggggaaccgtaaaggggtaaggaaagttaacgttaaaccgaaaacggtacgttaagggttcgggcttacggaaccctaactaacgtttcgttcggttcctttccgttaacgtttcccccg

SEQ ID NO: 400521 - DNA, 573 bp, Homo sapiens
  misc_feature: GZ8MTXP01C6V8V.15.28.C06.1.454.CMB.2.raw
  modified_base (275)..(275): a, c, t, g, unknown or other
  modified_base (277)..(278): a, c, t, g, unknown or other
  modified_base (281)..(282): a, c, t, g, unknown or other
  modified_base (284)..(284): a, c, t, g, unknown or other
  modified_base (310)..(310): a, c, t, g, unknown or other
  modified_base (318)..(318): a, c, t, g, unknown or other
  modified_base (371)..(371): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctgtcggagacagagtcaccatcacgttgccggcagtcagagtatactaaatggtgctggttcagcaagaacgagaacaccaancnntcnncncctctcttatcgagtaggtcggctanacgtagtnaggccgagtaggtgatcggaagataagtactcgacgtctaccactactcgacncgacgtcgtagctaacgtcgtacgtacgtttacttacgaaccttaacttactacgtacggtaaccgtaagtacaactaaattaaactacgttagttaacggttcgggacgggtaacggaacggtaggtaaggaattacgtaaacgaaacgtagtggttacgcttacgaaccatcgtacgttcttcgtaacttccgttccccg

SEQ ID NO: 400522 - DNA, 716 bp, Homo sapiens
  misc_feature: GZ8MTXP01C8JDU.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcactgccggcagtcagatattactaaagtggtggctgttcagcaagaaaccgaggaaacgaccccaaaagtcctagatctctcgccgtcctcttactttcgacgtaaacggttcggggtcccagtacgtaaacggttcgaggcccggacgaggtggactcgtagggaacaaggtaacttacgtaacgttactaccaaccgtactaccgagaccgaacggtcccttaggacctacggacccgttacggtaaccggttaatttttaccggaaccttaaaccctttaaccgttaaccgtacggtaacccgtaaacggttacgtaacctaaagtttaaacttaaacgttacgttaacggtttaccgggggaacggggtaaacgggtaaacccggaaaggggttaacgggaagttaaacgttaaaccgaaaaccggtaaacgttcggttaacggttccgttacggaacctaaccgtaacttcgttacgttaccttccgttaactttccccg

SEQ ID NO: 400523 - DNA, 881 bp, Homo sapiens
  misc_feature: GZ8MTXP01CCU6Q.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcacgttgccggcagtcagtagtattactaagtggttggcctggttcagacaagaaaccgagggaaacgacccaaaagtcctagactctctcgcccgtcctcttacgtttgacgtaaaacgggttccgggggtaccccaagttaccgtaaacggggtttccaaacggggtccccggggaccgtaaggggttaggggaaacgttccgggttaaacggggggaaaccctaagggtaaacgttttcccgaaacgggtttccctaacccggtaacccaacgtttacccgaacggtacccgtaaacggaccccgttcgggacccgtaacggtacccccgtttaaggggttaaacccggttttaacgttttttaaccgggaaccctttaaaaacccgttttacccttaaacccggttaccggggtaaaccccgttaaaaggggttttaccgaaacccgtttaaaagtttaaaaccgtttaaacctttacggttaaaccgggtttttaccgggggaacccgggggtaaacgggggtaacccgtaaagggggttaaggaaacggttaaacgttaaacccgaaaaacgggtaaaccgttgggttacgggccttacggaaccctaaccttaacgttcccggttacgtttacccgttaaccgttaaccgttttaacccccgg

SEQ ID NO: 400524 - DNA, 612 bp, Homo sapiens
  misc_feature: GZ8MTXP01AXDQG.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacgttggccggcagtcagtagtattactaaagtggttgcttggttcagacaagaaacgaagggaaacacccaaagtcctgatctctcgcccgtcctcttacttcgacgtaaaggtcgggtaccatcgaaggtcaggccggcagtggatcgtaagggaactgaacttcgagtcctacaccatacagcagccctgaccagccctagtacgttatttacgacttaacttactacctacggacctaagtcactaataaatactcgtacgttcggggacgggtaacgggaaccgtaaggggtaacgaagttaacgtaaaccgaaaacggtacgttacggttacgggttcttacggaaccctaactaacgtttctacgtttaccttaaccgttaacctttccccgg

SEQ ID NO: 400525 - DNA, 628 bp, Homo sapiens
  misc_feature: GZ8MTXP01BQ22U.15.28.C06.1.454.CMB.2.raw
  modified_base (419)..(419): a, c, t, g, unknown or other
  modified_base (425)..(425): a, c, t, g, unknown or other
  modified_base (587)..(587): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgaccaaatgtgacatccagatcgacccagtctccgtccaccctgtctgcatctggtcggagacagagtcacatctacgttcggccggcagtacagtattattactaaagtggttcgcttgttcagacaagaacgagggaaacacccaaagtctagatctctcgcctcctcttactttacgacgtaaacgggttcgggtaccagttacgtaaggtacgacggccgacggtagtggtatcggtaagggaacaagtaacttcgacgttcaccactactacgancacgcncgacgacgtacgtacgtacttacgttacacttaactacgtacgtacgtacgtaaggtcaactaataaagttacgtacgttaggttaccgggacgggtaacgggtaaccgtaggggtaagaacgttaacgtaaacgaacggtaacgtgggttacgttccgttnaacgtcctaattccggttattcccgttaacgttccgttccc

SEQ ID NO: 400526 - DNA, 570 bp, Homo sapiens
  misc_feature: GZ8MTXP01EBNUA.15.28.C06.1.454.CMB.2.raw
  modified_base (373)..(373): a, c, t, g, unknown or other
  modified_base (388)..(388): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaagtggttgctggttacagcagaaacagggaacgacccaaaagtcctagatctctcgccgtcctctactttgacaaaggtcggggtcccatcgtaaggttcagccggcagtggatcgtagggacaagtactcagtcncacatcacgcagccngacagcgtagacgttattacgactaacttactactcggactaagtcactaaataaagtaacttcgtaacgttccgggacgggtaacgggtaacgaagggtaaggtaacgaacgtaaacgaaacggtacgtagggacggcttacgaacctactaactcgttcgttccttaaccttcgttcccg

SEQ ID NO: 400527 - DNA, 616 bp, Homo sapiens
  misc_feature: GZ8MTXP01EO4QE.15.28.C06.1.454.CMB.2.raw
  modified_base (595)..(595): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctggtcggagacagagtcaccatcacttcggccggccagtcagtagttaattaactaagtggttggctggttcagacaagaaaccgaaggaaacgacccaaagtcctagatctctcgccgtccttacttactttgacgtaaacgggttcggggtaccagtacgaaggttcacggccggcgtaggtggtactcggtaagggaactaagtaactttaccgacgttcctaccaccgtactacgacgccacgccgtagcacgtccgtacgtaacgttacttttacgacctaacttactaccgtagaccgtaagtcaactaataaactactcgtaagtttcgggaacggacgggaacgaaggggtaacggaagttaactaacgaaacggacgtggagcagtccaacctnttcgtcttactcgttccgtcc

SEQ ID NO: 400528 - DNA, 626 bp, Homo sapiens
  misc_feature: GZ8MTXP01B3TBS.15.28.C06.1.454.CMB.2.raw
  modified_base (420)..(420): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgcatctgtcggagacagagtcacatcacgttcgccggcagtcagtagtattaactaaagtggtggtcttggttcagacaagaaaccgaggaaacgacccaaagtcctagatctctcgccgtccttactacgtttcgacgtaaacgggtcgggtacctagtacgtaaggtcacggccggctaggtggtatcgtaagggaactaagtaactcgacgtctacacatcagcacgtccngacacgtaccgtagtacgttactttacgacttaacttacgtacgtacggtaacctaaaggtcaactaaattaaactacgttacggttaacggtttacgggaacggggtaacggaaccgtaaggggtaacgaacgttaacgtaacgaaacgtacgtggttacgcttacgcctacgtaacttcgtcttaccttccgttaacttccccg

SEQ ID NO: 400529 - DNA, 633 bp, Homo sapiens
  misc_feature: GZ8MTXP01DZ6NG.15.28.C06.1.454.CMB.2.raw
  modified_base (535)..(535): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgtatctgtcggagacagagtcaccatcacttcgccgggccagtcagtagtattactaaagtggtggcctgttcagacaagaaacgaggaaacgacccaaaagtcctagatctcgtcgcccgtccttacttacgtttacgacgtaaagggtccgggtaccctaagtacgtaaggttcaaggcggtacgaggtaggacgtcggtaggaaacaagtaactcacgtcctacaccagtcacgcacgccctgaccgacgtcccgtagaccgttattcgaactaacttactacgcgtacgtaagtcgaactaataaactaagtcgtacgtttacggggacggtaaggacgtaagggngaaagtaacgttaaaccgaaacggttacgtaggttacgcgttacggaccctaacgtacttcgttaccttccttaactaacccttcccggttaaccccg

SEQ ID NO: 400530 - DNA, 751 bp, Homo sapiens
  misc_feature: GZ8MTXP01C3ZBV.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcaccatcacgttcggcccgggcagtcagtagttattactaaagtggttcggccttggttcagacaagaaaccgaagggaaacaccccgtaaaagtcctagactctctcgcccgtccttacttacgtttacggaaccgtaaacgggttcgggggtacccctaagtacgtaacgggttcacggtcccggacgtaggtaggacgtcgtaaggggaacaaggtaactttacgacgttactaccaaccgtatacgacgaccgacgtcccgttcgaccgtaacgggtaccccttagggtaaaccggttttatttttaccggaaacccttaaaccgttttaaaccttaacccgttacggggtaaccccgtaaagttaccggtaaaccttaaagtttaaaacttaacgttaactttaacggggtttaaccggggacggggtaaacggggacccgtaaagggggtaacggaaagttaacgtaaacgttaaaaccggtagtcggttaggccttacgaaccctaccttaagtcttcgttaccttcttaacttccccg

SEQ ID NO: 400531 - DNA, 608 bp, Homo sapiens
  misc_feature: GZ8MTXP01AU7OE.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcacgttcggccggccagtcagagtatactaagtggtgctgttcagcaagaacgaggaacgacccaaagtcctgactctctcgccgtctcttacttcgacgtaaggtcgggtaccatacgtaaggtcaggccggcaggtgatcgtaaggacaagtactcgacgtctacacatcgacgcgacgcctgacgtacgtccgtagtacgttacgtttacgaccttaacgttacctacgtacgggacgtaagtctaactaaattaaatactacgtaacggttacgggaacgggtaacgggtaaccgtaaggggtaaggaacgttaacgtaaaccgaaacgtaacggtggttacgcgttcgaacctactaacgtcgttacgttccttaaccttaacgtttccccg

SEQ ID NO: 400532 - DNA, 542 bp, Homo sapiens
  misc_feature: GZ8MTXP01C80QK.15.28.C06.1.454.CMB.2.raw
  modified_base (330)..(330): a, c, t, g, unknown or other
  modified_base (347)..(347): a, c, t, g, unknown or other
  modified_base (363)..(363): a, c, t, g, unknown or other
  modified_base (375)..(375): a, c, t, g, unknown or other
  modified_base (480)..(480): a, c, t, g, unknown or other
  modified_base (489)..(489): a, c, t, g, unknown or other
  modified_base (499)..(499): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctatttagaaggtgtccagtgtgaggtgcaactggtggagtcgtgggggagcctcgtccaggccggggggtccctgagactctcctgtgaagcctctggattcaccttgagcactattggatgacttgggtccgccaggctccgaggggagggctgggagtgggngccaccataacaaaagntggatgaccacaactngtgaaactctgngagtcggggccattcaccgtctccagagacgacgcaaagactcactacatctgacaaatggaaacaaccgtgaacgagccgaggtacacggtctagtgtattagngtgttgagngtatgttcgnggcggttggggaccaaggggacccctggacctccgttctcccg

SEQ ID NO: 400533 - DNA, 615 bp, Homo sapiens
  misc_feature: GZ8MTXP01ETIGT.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaatggtgctggttcagcagaacaggaaacacccaaaagtcctgatctctcgccgtcctcttactttgacgtaaacggttcggggtacccagttccgaaaggttcaacggcccggaccgtaaggtgggaattccggtaaaggggaaccaaggtaaacttcgacgttactaccacatacaacgcacggccctgacctagtacctagtaaccgttatttacgactaaacttactacgtacgactaagtcactaataaatatcgtaacggttcggcgggtaacggacgaaggggtaagaagttacgtaacgaaacgaacgttgttacgggcttacgggaacctaccgtaagttccgtacgttccttcgttaacctttccccg

SEQ ID NO: 400534 - DNA, 548 bp, Homo sapiens
  misc_feature: GZ8MTXP01C1SXO.15.28.C06.1.454.CMB.2.raw
  modified_base (419)..(419): a, c, t, g, unknown or other
  modified_base (536)..(536): a, c, t, g, unknown or other
  modified_base (538)..(548): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgacaaatgaacaacctgagagccgaggacacggctgtgtattactgtgtgagagtatgttctggcggttgggggacccagggacccttggccaccgtctcctcacgcctccaccgaagggccccatccgggtcctcccccgtgggccctccctgcctccgaggcnccacccgtcgagacgacacagcacgcccgtgggcctcggccttgggaccaaagggtaccttacgttcccgacgtacgtaagctggacggtcgggcgtgggccaagggccgagagtgngnnnnnnnnnnn

SEQ ID NO: 400535 - DNA, 514 bp, Homo sapiens
  misc_feature: GZ8MTXP01C5DTV.15.28.C06.1.454.CMB.2.raw
  modified_base (243)..(243): a, c, t, g, unknown or other
  modified_base (246)..(246): a, c, t, g, unknown or other
  modified_base (248)..(248): a, c, t, g, unknown or other
  modified_base (257)..(257): a, c, t, g, unknown or other
  modified_base (263)..(263): a, c, t, g, unknown or other
  modified_base (265)..(270): a, c, t, g, unknown or other
  modified_base (272)..(272): a, c, t, g, unknown or other
  modified_base (275)..(275): a, c, t, g, unknown or other
  modified_base (279)..(279): a, c, t, g, unknown or other
  modified_base (295)..(295): a, c, t, g, unknown or other
  modified_base (300)..(300): a, c, t, g, unknown or other
  modified_base (303)..(303): a, c, t, g, unknown or other
  modified_base (305)..(305): a, c, t, g, unknown or other
  modified_base (314)..(314): a, c, t, g, unknown or other
  modified_base (323)..(323): a, c, t, g, unknown or other
  modified_base (328)..(328): a, c, t, g, unknown or other
  modified_base (349)..(349): a, c, t, g, unknown or other
  modified_base (379)..(379): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgcggagacagagtcacatcactgccggcagtcagatatactaatggtgctgtnagnanaacaggaanccaaancnnnnnncnctntatncaagtggccatcagtnagcgnagngntcgaggacngatcagtcncacancagcagcctgcagctgacgtntttacgactaacttacactggacctaagtnactaataatatcgtagttcgggacgggtaacggaaccgaaggggtggaaagacgtaaacgaaaacgtaacgtggttacgggcttacggaacctaaccgtcgttcttacggttaccttaacgttaacctttccccg

SEQ ID NO: 400536 - DNA, 606 bp, Homo sapiens
  misc_feature: GZ8MTXP01DG560.15.28.C06.1.454.CMB.2.raw
  modified_base (267)..(267): a, c, t, g, unknown or other
  modified_base (279)..(279): a, c, t, g, unknown or other
  modified_base (377)..(377): a, c, t, g, unknown or other
  modified_base (394)..(394): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttggccgggccagtcagagtatactaaatggtgctgttcagcagaacaggaaanacccaaagtccngatctctcgccgtcctcttactttgacgtaaacgggtcgggggtaccccagtacctaaagggttcaaggcccggactaggtggactcgtaggggaacngaattcagtctacactncagcagctgcagctagacgtatttcgactaacttacgtactcggggtaacctaaggtactactaaataaattaacgttacgtagttttaccggggacggaaacggggtaaccgaaagggggttaaggaaacggttactaaaccggaaagtaaccgtggttacggttccttaggaacctacgtaacttctggttaccttaacaacgtttcccc

SEQ ID NO: 400537 - DNA, 649 bp, Homo sapiens
  misc_feature: GZ8MTXP01DL0MP.15.28.C06.1.454.CMB.2.raw
tcagtctacgtagccacgaccggtgctcgatttagagctcacgtattgggtttgggggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagagtcaccatcacttgccggcagtcagagtattactaaatggtgctgttcagcagaacaggaaacacccaaagtcctagatctcgtcgcccgtccttacttactttgacgtaaagggttcggggtacctatacgaaaggttcacggccggcgaggtggtaactcgtaaggggactaaggtaaacttcgacgttctaccactatccagcacggcccgtgctacgtccttacgtacgttagttttcgaccttaaacgttactacgtcggaacctaaggttctaactaaagttaaataacgttacgtacggtttcggggaacgggtaacgggaaccggtaaaggggtaacgggaaagttacgttaaaccgaaaacggtaacgtcgggttacgggttcttacggccctaaactcgttcgttacgttccttaaccgttaacgtttccccg

SEQ ID NO: 400538 - DNA, 647 bp, Homo sapiens
  misc_feature: GZ8MTXP01DBNJK.15.28.C06.1.454.CMB.2.raw
  modified_base (249)..(249): a, c, t, g, unknown or other
  modified_base (500)..(500): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagatcacatcacgtgccggcagtcagtatattataagtggtgctgttnagacagaacgaggaacacccaaagtcctagactctctcgcccgtcttacttactttcggacgtaaacgggttcggggtaccctagttaccgtaaaggttcacggtcccggacgtaggtggtactcgggtaacgggaactaaggtaactttaccgaacgttccaaccgacctaatccgaacggcaacggtcctgacgtacgtccgtagtaccgttatttacgacttaaccttaactacgtacgactaagtanactaaataatacgtcgtacggttcgggacgggtaacgggacgtaagggttaaggaaacgttagtaaaccgaacgttaaagtgggttacgttccgttacgtaacccaacgttcttacgttcgtttaccttccgttaacctttcccccg

SEQ ID NO: 400539 - DNA, 677 bp, Homo sapiens
  misc_feature: GZ8MTXP01BZ55S.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacgttcggcccgggccagtcaagtagttaattaactaaagtggttcggtccttggttcagacaacggaaaccgaagggaaacgaccccaaaagtcctagtatcctcgtcgcccgtccttctacgtttgacgtaaagggtcgggtacctagtcgtaaggttcgaggccggacaggtgactcgtaaggggactaagtaatccgtagtctacaccatccgacgtcacggcctggaccacgtccctgtaccgttatttacgaccttaaacgttactacgttacggacctaaggtctaactaattaaactacgtcgttaacggtttccggggaacgggtaacggggtaaccgtaaggggtaacgggtaaagacgttaaaccgaaaacggttaccggttaggttcggttccgttacggaaccctaaccgttaacgttccttacggttaccctttccgttaaccgtttccccg

SEQ ID NO: 400540 - DNA, 619 bp, Homo sapiens
  misc_feature: GZ8MTXP01A5BIC.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaatggtgctgttcagcagaacgaggaacacccaaagtcctagatctctcgccgtcctacttacgtttagacgtaaaggttcggggtaccagttacgaacggttcgacggccggacgaggtggagtcgtaagggactaagtaacttcgagtcctacaccatcagcacgctgacacgtccgtagtacgtagtttacgacttaaacttactacgtcggtaccgtaaggtcactaattaaactaattacgtaacggtttcggggaacgggtacggggtaaccgaaggggtaaggaaacggttactaaaccgaaacggtaaacgtttgggacgggttcttaccggaactacctaactttcgtacgtttccttccttaacgtttccccg

SEQ ID NO: 400541 - DNA, 576 bp, Homo sapiens
  misc_feature: GZ8MTXP01EVM9G.15.28.C06.1.454.CMB.2.raw
  modified_base (461)..(461): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggtggctggttcagcagaaacgaggaaacgacccaaaagtcctagatctctcgccgtcctcttacgtttcgacgtaaacggtcgggggtacccagtaccgtaaggttcaggcccggctaaggtggatcgtaagggacaaggtaattcagtctacacatcagcagctgacacgtacctagtaccgtatttcgactaacttactactcgggacctaaggtnacaattaactaatcgtaagtttcgggacgggtacggaccgaagggtgaagttataacgaaaccgtaatcggttaggcttacgaactactaacttctgttcttcttaacgttcccg

SEQ ID NO: 400542 - DNA, 551 bp, Homo sapiens
  misc_feature: GZ8MTXP01E34RU.15.28.C06.1.454.CMB.2.raw
  modified_base (199)..(199): a, c, t, g, unknown or other
  modified_base (265)..(265): a, c, t, g, unknown or other
  modified_base (530)..(530): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccggcagtcagagtattactaatggtgctggttcagcagaacaggaanacccaaagtctgatctctgccgctctactttgacgaaagtcgggtccatcaaggttcagccggcaggtgatcgtagggacaagaatcagtctcacatcagcacgcctgcagcctagtacgtatttgactaaacttactactcgggacaaggtcactaattaaattaataccgtagtttccggggacgggtaacgggaccgaaaggggtcggaaagttaacgtacgaaaacggaacttgggttcggcttaggaacactaattcgtnttccttaacgaacgtttcccc

SEQ ID NO: 400543 - DNA, 602 bp, Homo sapiens
  misc_feature: GZ8MTXP01AT4RA.15.28.C06.1.454.CMB.2.raw
  modified_base (277)..(277): a, c, t, g, unknown or other
  modified_base (283)..(283): a, c, t, g, unknown or other
  modified_base (330)..(330): a, c, t, g, unknown or other
  modified_base (348)..(348): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccgggcagtcagtagtattactaatggtgctgttcagcagaacaggaacacccaaagtcnatctcncgccgcctctacttgacgaagtcgggccatcgaagttcacgccgganaggtgatcgtaagggacngaattcagtctcacatacagcacgctagcgaagtcccgtagtacgttatttacgactaaaccttactacgtacgaccgtaaggtacaacctaaattaaacgttaagttccgttaaacggtttccgggtaccgggggaaaggggtaacccgtaagggggttaacgaaacggttaacgtaaacgttaaacggtaaacgttggttcggttacgttcggaaccacctaagtcccttgttacctcgttaactttccccg

SEQ ID NO: 400544 - DNA, 703 bp, Homo sapiens
  misc_feature: GZ8MTXP01ADK1O.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctggtcggagacagagtcaccatcacttggccggcagtcagtagttataactaagtggtgctggttcagcaagaacgagggaaacacccaaaagtcctagatcctctcgcccgtcctcttacgttcgacgtaaacggttcgggtaccagtacgtaaggttcaggccggcgaggtacggacgtcggtaagggaactaagtaacttacgacgttactaccactaactaccgacgaccgtacggtcccgtacgaccgtacgtaccgttacggtaacgttacgttttacgaaacccttaaactttaaccgttaaccgtaccggggtaccgtaaaggtacgtaaaccttaaagttaaacttaacgttaccgttaacggggtttacccggggtacggggaaaccggggtaaaccggttaaaggggaacggtaaacgttaaacggtaaacgttaaaccggtaagtcggttacggcttacggaacctactaattcgttacttctccgttaacgttccccg

SEQ ID NO: 400545 - DNA, 762 bp, Homo sapiens
  misc_feature: GZ8MTXP01ESBKA.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtcctccgtccaccctgtctgcatctgtcggagacagatcacatcacttcgccggccagtcagagtatactaagtggttggctggttcagcagaaacgaggaaacgacccaaaagtcctagactctctcgcccgtcctacttactttacgacgaaacgggttcgggggtacccagttacgtaaggttcaggtccggcgtaggtggtactccggtaggggaacaagtaacgttacacggttacctacctaaccacttaccgacgaccgaacgtccccgtgccgacggtaccccgttaggtaaccggttacttttacggaaccttaaaaccctttaaccgttaacccgttacgggggtaaaccccttaaaggggttaccccgtaaacttaaaagttaaaactttaaaacgtttaacccggtttaacgggttttaccccggggggaaaccgggggtaaaccggggggtaaacccggtaaacgggggttaaaggggaaacccgttaaaggttaaacccgttaaaaccggtaaacggttcgggttacggttcgttacggaacctaacctcgttctacgttacctttaaccgttctttcccccg

SEQ ID NO: 400546 - DNA, 779 bp, Homo sapiens
  misc_feature: GZ8MTXP01DF4BP.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcacatcacgtcggccggcagtcagagtaattactaaagtggttgcttggttcagacaagaaacgaggaaacgacccgaaagtcctagactctctcgccgtccttacgttacttcgacgtaaacgggttcggtacctagtacgtaacggttcgacggtccggacgtaggtggtactcggtaagggaactaaggtaaacttaccgacgttacctaccaacctacgtaccgaacgaccgtaccggtcccgtcggtaccgtaacggtacccgtttaacgggttaaccgttttaacgtttttaccggaaaccctttaaaccggttttaacccctttaacccgttaaccgggggtaaaccccttaaagggttaaccgtaaaccgttaaaatttaaaacgtttaaacgtttaccggtttaaaccgggtttaccgggggaaacgggggttaaaccgggaaacccggtaaagggggtaacggtaacgttaaacgtaaaccgaaaacggtaccggttgggttaacggttccgttacggaacctacttaacgttccgttcgttacctttccgttaacgtttccccg

SEQ ID NO: 400547 - DNA, 559 bp, Homo sapiens
  misc_feature: GZ8MTXP01ARCMW.15.28.C06.1.454.CMB.2.raw
  modified_base (535)..(535): a, c, t, g, unknown or other
  modified_base (545)..(545): a, c, t, g, unknown or other
  modified_base (549)..(549): a, c, t, g, unknown or other
tcagtctacgtagccacgaccggtgctcgatttagagctcacgtattgggtttggggggagtcagactcagtcaggacacagcatggacatgagggtcccgctcagctcctggggctcctgctgctctggctcccaggtgccaaatgtgacatccagatgacccagtctccgtccaccctgtctgcatctgtcggagacagagtcaccatcacttggccggccagtcagagtattactaaagtggttggcctggttcagcaagaaaccgagggaaacgaccccaaaagtcctagaactctctcgcccgtccttcttactttcgacgtaaagggttcgggggtacccctagttaccgaaagggttcaaggcccgggtacaggtgggatcgtaagggaacaaggtaaattcgagtctacacatccagcacgccgtgcagcctagtacgtatttgactaacgttctacgtgaccaaggtcactaataaatatcgtagtttcggaggaggacgagggtgaagatacaaagactgttcgnttcgcacctntctnttctcttctc

SEQ ID NO: 400548 - DNA, 588 bp, Homo sapiens
  misc_feature: GZ8MTXP01EFEY0.15.28.C06.1.454.CMB.2.raw
  modified_base (199)..(199): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcgganacaggatcacatcacgttcgccggcagtcagtagtataactaagtggttgctgttcagcaagaacgaggaaacaccctaaaagtcctgactctctcgccgtccttactacgtttcgacgtaaagggtcgggtaccctagtacgtaaggtcaggccgcgtaggtcggtatcggtaagggaactaaggtaacttcgtaacgtcctaccacctatcaacgcaacgccgtcgacgacgtacccgtagtacgttatttacacttaacttactacgtcggactagtcactaataatatacgtaggttcggacgggtaaggacgagggtaagattactacgaaagtgtcgcgttcttacgcctataacgttctcgttactaaccgttcgtttcccg

SEQ ID NO: 400549 - DNA, 660 bp, Homo sapiens
  misc_feature: GZ8MTXP01EWRJF.15.28.C06.1.454.CMB.2.raw
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaggtgtccagtgtgaggtgcaacgtggtggagtcgtgggggagcctcgtccgaggccggggggtcctgagactctcctgtgaagcctctggattcaccttgagcacttagttggatgacgttcgggtccgccgaggcctccgaagggggaacggggcgtgggaggtggggtcggaccaaccgaataaacgaaaaaagagtaggaaacgtgaaacacaaacctatagtagaactcgtgtagagtcggggaccgtacgtttcccgacccgttcctccctacgacgtcccctacccgaacccgaacgggtcccctacgtcccggttccccttcccccgtggccccgcccggtacgcctccgacggacgccccaccgtccggagacgccgaaccgcggtcccggcccgtgggcctcggttcccgtggtacgaacggttccttaccgtcccgacgttaacggagtaccggcggtaacggcgggtcg

SEQ ID NO: 400550 - DNA, 661 bp, Homo sapiens
  misc_feature: GZ8MTXP01C9MNJ.15.28.C06.1.454.CMB.2.raw
  modified_base (202)..(202): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatcgtggtcgganacagagtccacatcacgtcggccggccagtacagatattactaagtggtgctgttcagacaagaacgaggaaacacccaaagtcctagactctctcgcccgtcctacttacttcgacgtaaacgggttcgggggtacctaagttacgtaacggttcgacggtcccgggacgtacgggtggtacgtacggtaacggggtaactaagtaaacttccgaacgttcctaccacctatacgacgcgaacggtccagaccgtacgaccgtaggtactttacgtttacgaactaacttactaccgttcggaaaccgtaaggtactactaaattaaacttaacgttacgttaacggttacgggacgggtaacgggaaccgtaagggtaacggaagataaacgaaacgttaacgtggttacggcttacgcctacgtaacttcgtcttaccttccttaacgtttccccg

SEQ ID NO: 400551 - DNA, 820 bp, Homo sapiens
  misc_feature: GZ8MTXP01DQ6MN.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggttgctgttcagcagaacaggaaacgacccaaaagtcctgatactctacgtccgcctctactttcggactaaaagggttcgggggtaccccagtaccgtaaacggtttcgaacggccgggtacctagggttacgggtaacgttccggttaacggggggaaacctaagggtaaaacttttccgggtaaacgtttcccttaccaaaccctacgttaccaaacgggttctaaacggccccgttaggtcccgaaggtacccccgttagggttaaccggttaaacgtttttttaccgggaaccttaaaacccttttaaccgttaaacccgtttacgggggttaacccccgttaaaagggttcggtaaacccgttaaaattaaaacgtttaaactttaacctttaaacgggggtttttaccgggggaaccgggggtttaaacggggaaccccgggtaaagggggttaacggggaaagttacggtaaaccggttaaaaaccggtaaaccggttgggttaacggggttcttacgggtaaccaaaccttaacggttctcggtttactttcccgttaacttttcccccgg

SEQ ID NO: 400552 - DNA, 613 bp, Homo sapiens
  misc_feature: GZ8MTXP01DTNFE.15.28.C06.1.454.CMB.2.raw
  modified_base (197)..(197): a, c, t, g, unknown or other
  modified_base (420)..(420): a, c, t, g, unknown or other
  modified_base (475)..(475): a, c, t, g, unknown or other
  modified_base (579)..(579): a, c, t, g, unknown or other
tcagtctacgtagccacgaccggtgctcgatttagagctcacgtattgggtttggggggagtcagactcagtcaggacacagaatggacatgagggtccccgctcagctcctggggctcctgctgctctggctcccaggtgccaaatgtgacatccagatgacccagtctccgtccacctgtctgcatctgtcgganacagagtcaccatcacttgccggccagtcagtagtattaactaaattggttggcctggttcagacaagaaaccgagggaaaccacccaaaagtcctagactctctcgccgtccttcgttactttgacgtaaaggtcggggtaccagtacgaaggttcaggtcggaccgtaggtggacgttcgagggaacaagtaatcagtcctcaacatcagcacgcctgacncgtactacgtagttactttcgaccttaacttacctaacgtcgaaccgtaagttanaaccttaaattaaacttaacttcgtaacggtttacgggacgggtaacgggaacgtaagggtagaacgtaacgttaacgaaacgttacgtggtggcttcgacctntacttcgtctacgttctaacgttcccttaacccg

SEQ ID NO: 400553 - DNA, 741 bp, Homo sapiens
  misc_feature: GZ8MTXP01C8EM8.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctcccgtccaccctgtctgcatctggtcggagacagacgtccacatccacgttcggccggcagtcagagttaattactaaagtggttggcctggttcagacaagaaccgaggaaacgacccaaagtcctgactctctcgccgtcctacttacttgacgtaacgggttcgggtacctagtacgtaacggttcgacggccggactaggtggtacgtcggtaacgggaactaaggtaacttcgaacgttacctacaacctatcgacgtacgaaccgtccgcgaccgtacggtaccgttacggttaacccggtttaatttttacccggaaaccgtttaaacctttaaaccgttaacccgtacggggtaaccccgtaaagggttaccgtaaacgttaaaatttaaacttaaacgttaccgttaaaccgggtttcgggggaaaccggggtaacggggtaaacccgggtaaaggggtaacggaaaggttaaacgtaaaccgaaacggttaaaccgtgggttacggcgttaccggtaaccacgttaacgtttcgtacgttaccttccgaacttttccccg

SEQ ID NO: 400554 - DNA, 679 bp, Homo sapiens
  misc_feature: GZ8MTXP01D9C02.15.28.C06.1.454.CMB.2.raw
  modified_base (196)..(196): a, c, t, g, unknown or other
  modified_base (258)..(258): a, c, t, g, unknown or other
  modified_base (270)..(270): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtcaccctgtctgcatctgtcgganacagatcacatcacttgccggcagtcagatatactaatgtgctgttcagcagaacaggaaancccaaaagtccngactctctcgccgtctcttacgttcgacgtaaacggttcggacctagtacgtaagtcgacggtccgacgtaggtagacttcgtaaacgggaactaagtaacgttaccgaacgtacctacctactacgacgaccgacggtaacccgtcgacgtaccgtacgttacgtacgttacgtttacgttacgaaaccttaaacgttaccgttaacgtacggtaaacgttaagtaacgtaaacttaaagttaaacgttaacgttacgttaacgggttacgggaacgggtaacggtaaacggtaagggtaacgtaaacgttaaacgtaaacgttaaacgtagttcggttacgttccgttaacgaaccgttaacgtaacgtttacgttaccgtttaccttccgttaaccgttaaccccg

SEQ ID NO: 400555 - DNA, 629 bp, Homo sapiens
  misc_feature: GZ8MTXP01AFV9M.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggcagtcagagtattactaaatggttggctggttcagacaagaaaccgaagggaaacgaccccaaaagtcctagactctctcgcccgtcctcttactttcgactaaacggtcggggtacccagtacgaaggtttcgacgcccggcgtaggtcggtaactcgtaagggaccaagtaatttcacgtctacacatacgacgcgacgcctgccgacgtccgtagtacgtatttcgactaacttactactcgggaccaaaggtcacaaattaaattaacgtcgtaaacggtttcggggaacgggtaacgggaaccgtaagggttaagaacggttaactaaaccgaaaacggtacctagggttgaccgttcggaaccctactaacttctcggttaccttccttaacgtttccccg

SEQ ID NO: 400556 - DNA, 756 bp, Homo sapiens
  misc_feature: GZ8MTXP01EOZTI.15.28.C06.1.454.CMB.2.raw
  modified_base (199)..(199): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagagtcaccatcacttcgccggcagtcagagtattactaaagtggttggctggttcagacaagaaaccgagggaaacgaccccgaaaagtcctagactctctacgcccgtccttacttacgtttgacgaaacggttcgggggtaccctagttacgtaagggttacaggcccggcaggtggatccgtaggggaactaaggtaacttcgacgttcctaccaaccattacgacgaccgacgtcccgtggaccacgtaccccgttaggtaaccgttactttttacggaacccttaaaacgtttaccctaaaccgtttacggggaaccccgttaaaagggttccgtaaaccttaaagtttaaaactaaacgtttacccgttaaacgggtttttcccgggggaaccgggggtaaacgggggtaaacccggtaaagggggttaagggaaacggttaaacgtaaacccgttaaaacgggtaaaccgttgggttaccgggttccttacggaaccctaaaccttcgttacttccggttacctttaaccgttaacttttcccccgg

SEQ ID NO: 400557 - DNA, 715 bp, Homo sapiens
  misc_feature: GZ8MTXP01DJXWF.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcattcgtggtcggagacagatcaccatcactgccggcagtcagtatattactaagtggtgctgttcagacagaacaggaacacccaaagtcctagatctctcgccgtccttacttactttgacgtaaagggttcgggtacccagttacgtaaaggttcacggccggactaggtggaatcggtaagggaactaagtaaactttcgacgttcctaccaaccctataccgaacgaccgaacgcccgtacggaccgtaacggtaccccgttaggtaacccgtttaagtttttacgaaccctttaaaaccgtttaaccttaaccgttacggaacccgttaaaggttcgtaaacctaaatttaaaacttaacgttaccgttaaggtttaccggggaacgggaaacgggtaaccggtaaagggttaaggaaacgttaaacgttaaacgaaaacggtaacgttcgggttacggccttacggaaccctaaccttaacgtttcgttacgtttcccttaaccgttaaccgtttcccccg

SEQ ID NO: 400558 - DNA, 777 bp, Homo sapiens
  misc_feature: GZ8MTXP01BZ9UD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagacgtcaccatcacttcgccggcagtcagtagtatactaatggtgctgttcagcaagaacgaggaaacaccaaagtccagtatctctacgccgtctcttacgtttagaccgtaaagggtcgggtaccctagttaccgaaaggttccgaggtcccggaccgtaggttaggaaccgttacggtaaaggggaaacctaaggtaaacttttacgggaacgtttaccctaaccaaaccctaaacgtacgaacgaccgtaccggtacccgtaccgtaccgtaacccgtaccgttaacgttaacggtttaacgtttaacgttaaccgttaaaccgtttaaaccgttaaccgttaaccggtaacgttaaacgttaacgtaaacgttaaaacttaaaacgttaaacgttaaccggttaacggttaaccggggtaaccggggtaaaccggggtaaaccgggtaaacgggtaaacgggtaaacggttaaacgtaaacgttaaaacggtaaacggtacggttacggttacgttacgtaacctaaccgtaacgttacgttacgttaccttaaccgttaaccgttaacccg

SEQ ID NO: 400559 - DNA, 696 bp, Homo sapiens
  misc_feature: GZ8MTXP01DA4IM.15.28.C06.1.454.CMB.2.raw
  modified_base (257)..(257): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagagtccacatcacgttggccgggcagtcaggtatataatagtggtcgtgttgtnagacgaacgaacggaaggaaacccaacaaacgtcgatactctcgtccgcctcccttactttacgtacgaaggtacgggggttccgtactacgtacgttaacggtcgcgggtcccgagtacgggtagtaccgtcggggtaacggaactaagttacctacggtacttaccacctaacgtacagggaccacgggaccttccggagaccgtacccgttacggtaagtacgtttttacgtaccaaacctttaaacttaccgtaggtaccctaaagtagtaccaaattaaactaaagttctaacggtttacgggggccggggaaacgggttaaacccggagggttaaaggaacggttaaacgaacctaaacgggaaacggtgttcggggaccgttcgacctaaccgtactggttcttacgttcctaacggttaacccttcccccg

SEQ ID NO: 400560 - DNA, 545 bp, Homo sapiens
  misc_feature: GZ8MTXP01AJWWM.15.28.C06.1.454.CMB.2.raw
  modified_base (375)..(375): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgagacagagtcacatcacttgccggccagtcagagtatactaaatggttgctggttcagcagaacaggaacgacccaaagtcctgatctctgccgctctacttgacaaaggtcggggtcccatcaaggttcagccggcagtggatcgtagggacaagatcagtctcacatcagcagcctgcngtcctgacgtatttcgactaacttactactcggactaagtcgactaattaaactatctaagtttcggacgggtaagggaaccaagggtaacgaagacgttaacgaaacggtaaccgtggttcggacttcggaacctacaacgttcctgttacccttcgaacgtttccccg

SEQ ID NO: 400561 - DNA, 683 bp, Homo sapiens
  misc_feature: GZ8MTXP01B4CTO.15.28.C06.1.454.CMB.2.raw
  modified_base (197)..(197): a, c, t, g, unknown or other
  modified_base (252)..(252): a, c, t, g, unknown or other
  modified_base (412)..(412): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagacgtcacatcacttcggccggcagtcagtagtattactaaatggtgctgtnagcagaacaggaacacccaaagtcctgactctctcgccgtctcttacgtttgacgtaaacgggtcggggtaccctaagtcgtaacggttcgacggtcccggtacgaggtggactcggtaagggactaaggtaaacttcgacgtactaccacataccgacncgaacgtccgtgaccgagtacccgtaggtacttaccgttttacgaaccttaaaccttactaccgttacgggaaccgtaaaggttcaaaccgttaattaaaaccttacgtaccgtttaacgggttaccggggaaaccggggtaacgggtaaaccggtaaggggtaacgggaaagttaccgtaaacggttaaaacgtaaaccggtggttacgttccggttaaacccgccgtaccttaacgttccgttcgttaccttaaccgttcccgttcccg

SEQ ID NO: 400562 - DNA, 582 bp, Homo sapiens
  misc_feature: GZ8MTXP01C32NI.15.28.C06.1.454.CMB.2.raw
  modified_base (276)..(276): a, c, t, g, unknown or other
  modified_base (287)..(287): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaaatggtgctggttcagcagaacgaggaacaccaaagtctnatctctcgccnctctacttgacgtaaggtcgggaccatacgaaggttcacgccggacaggtgatcgtaagggacaagtactcagtctacacatcagcacgcctgcacgctaggtacttatttcgaactaaccttactacgtacggaccgtaagtacactaaataaattaactctaacggtttacgggacgggtaacggaaccgtaaagggtggaaacgaacgttaaacgaaaccggttaagtggttacgggcttacggaacctaaaccgttcgttcgttacgttaccttaacgttaaccgttcccg

SEQ ID NO: 400563 - DNA, 555 bp, Homo sapiens
  misc_feature: GZ8MTXP01BK4KN.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttcgccggcagtcagatattactaagtggtgctgttcagcagaacgaggaaacgacccaaagtcctagatctctcgccgtcctcttactttgacgtaaaggttcggggtacccatacgaaggttcacgccggcgaggtggatcgtaagggacaagtaattcagtctacacatcgagcacgcctgccagtcctagtacttagtttacgacttaacttactactcggacctaagtcactaataatatcgtagttcggagggacggacgaagggtaaggaagacgtaacgaaacgtacgtggttagcttcgaacactaattctgttccttcgttaacttcccg

SEQ ID NO: 400564 - DNA, 582 bp, Homo sapiens
  misc_feature: GZ8MTXP01B7S75.15.28.C06.1.454.CMB.2.raw
  modified_base (461)..(461): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggtgctggttcagcagaacaggaaacgacccaaagtcctgatctctcgccgtcccttcttacgtttcgacgtaaacggttcggggtacccagtaccgtaaggttcaggccggctagtggatcgtaagggacaaggtattcgagtcctacgactatcgagtcacgcctgccgacgtccctagtacgttactttcgacttaacttactacgtacggactaaggtnactaattaaatacgtcgtaagttcggacgggaaggaccgtaagggtaaggaagttacgtaaccaaacgtaacgtggttacgcgttcgaacctactaatctgttccttcttaacgttccccg

SEQ ID NO: 400565 - DNA, 713 bp, Homo sapiens
  misc_feature: GZ8MTXP01A6MGY.15.28.C06.1.454.CMB.2.raw
  modified_base (285)..(285): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccgggcagtcagtagtattactaaagtggtgcctggttcagcaagaacaggaaacgacccaaagtccngatctctcgccgccttactactttcgacgtaaacggttcggggtacccctagtaccgtaaaggttcaggccccggacgtaggtggtaacgtcggttaagggggaacctaagggtaactttaccgaacgggttccctaccaaaccctacgttaccgaacggaccacggtacccgttggaccgtaccggtaccgttacggtaccgttaagttttacggacttaaaccggtttactaccgtacgggtaaccgtaaaggttcaacttaaattaaactaacgttcgaacgggtttccgggaacggggtaaccgggtaaaccgtaggggttaaggaacgttaaacggtaaccgaaaacggttacgtagggttaccggttcgaccggtaaccgtaccctaatttcgtcgttaccttccgttaacctttcccccgg

SEQ ID NO: 400566 - DNA, 606 bp, Homo sapiens
  misc_feature: GZ8MTXP01BMKG9.15.28.C06.1.454.CMB.2.raw
  modified_base (289)..(289): a, c, t, g, unknown or other
  modified_base (335)..(335): a, c, t, g, unknown or other
tcagtctacgtagccacgaccggtgctcgatttagagctcacgtattgggtttggggggaagaggaagactgaaggcctttccacttggtgatcagcactgagcacagaggactcaccatggaattggggctgagctgggttttccttgttgctattttagaaggtgtccagtgtgaggtgcaactggtggagtcgtgggggagcctcgtccgaggccggggggtccctgagactctcctgtgaagcctctggacttcaccttgagcacttattggatgacttgggccncaggctccgagggagggctggagtgggtgccaccataacaaaaagntaggaagtgacacaactatgtgaacctgtgtgagtcgggaccgtattcccgaccgtcaccagacgacgacacccaaagacctcactacagtctagacaaatcgaaacaccgtgagacgaccgggaggacgacggtctagtgtactttagtaggttgagagtaagtcgttgttcgttggtcgggttacgggggcccgtaacggggttaccccgttggttaccccgtaacccgtccttcccgacacggccccctaaccgaacccgaacccggg

SEQ ID NO: 400567 - DNA, 818 bp, Homo sapiens
  misc_feature: GZ8MTXP01D5KE9.15.28.C06.1.454.CMB.2.raw
  modified_base (367)..(367): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgcatctggtcggagacagagtcaccatcacgtgccggcagtcagtatattactaagtggttgctggttcagacagaaacgaggaaacacccaaagtcctagactctctcgcccgtccttacttacgtttgacgtaaaggttcggggtacccctagttacgtaaggttcgaacggtcccggngtacggtggacttaccggtaaggggaaacctaagggtaaaactttccgtaaacgggtttaccctaaccccgaaccgtacttacccgaaacgggtcccaaacgggtcccgttacggaccgtaaaccgggttccccgtttaacgggttaaccggttaacgtttttacccgtaaccttaaaaccctttaaacttaacccgtaccggtaaccccgttaaaaggttaccgtaacccttaaaaagtttaaaccgttaaactttaccccggttaaagggttttacccgggggaaccggggtaaaccgggggtaaacccgtaagggggttaaagggaacgttaaacggtaaaccccgaaaaacgggttagttacccgggttaagggttcccgttaacgcccctaaacttaaccgggtttcccttcggttttacccttaaccgttaaccttttcccccgg

SEQ ID NO: 400568 - DNA, 550 bp, Homo sapiens
  misc_feature: GZ8MTXP01E4KI4.15.28.C06.1.454.CMB.2.raw
  modified_base (265)..(265): a, c, t, g, unknown or other
  modified_base (346)..(346): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaatggtgctgttcagcagaacaggaaancccaaaagtcctgatctctgccgcctctactttgacaaagtcgggtccatcaaggttcagccggcagtgatcgtagggacngaattcagtctcacatcagcagctgcagcctgacgtatttgctaacttacactggaccaagtcgacaattaaataagtctaagtttcgggaccgggtaaggggaaacccgaaaggggtcggaaagaacgttacgaaaaaacggtaaacgttggacgggcttacggccaacctaacttctcggttcctttaacgaactttccccg

SEQ ID NO: 400569 - DNA, 801 bp, Homo sapiens
  misc_feature: GZ8MTXP01CQB03.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatcgtggtacggagacagacgtccacatcgacgtcggccggccagtacagtagttattaacgtaaagttggttcggtccgttggttacacggacgaaacggaaaccgaacgggaaccaacccctaaagtcctagtactctcgtcgtcccgtccttacgttacgttagacgtaacgggttcgggtacctagtacgtaacggttcgacggtccggacgtaggtcggtacgtaccggtaaacgggaactaagtaaacgtttacccgaagttacccgtaccaaacctaacgtaccgaccgtacgacccggtcccgttacggaccgtaaccgggtacccgtttaacggttaaccgtttaacgttttaaccgtaaaccctttaaaccgtttaaccgtaccgttaaccgggtaaccggttaaaggttaccgtaaacgttaaactttaaacgttaaacttaccggttaacgggtttacccggggaacggggtaaaccgggtaccgaaaggggtaacgtaaacgttaacggtaaaccgaaacgtaacgggttcgttacggttccgttacgaaccttaaccgttgttccgttacgttacctttaaccttccgtttaaccccg

SEQ ID NO: 400570 - DNA, 571 bp, Homo sapiens
  misc_feature: GZ8MTXP01BLNKW.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaaatggtggctggttcagcagaacaggaaacacccaaaagtcctagatctctcgaccgtcctctactttgacaaaggtcggggtaccagtcaaggttcagtccggacaggtggatcgtagggaactaaggaattcgagtcctacacatcagctacgcctgcagtaccgtgtacgttatttcgactaacttactacgtcggacctaaggtcactaataatatctacgtttcggacgggtaagggaccgaaagggtgggaagttactaacgaaacgtaacgtggacgggcttacggaactaccctaattcgtcgttcttccgttaacgtttccccg

SEQ ID NO: 400571 - DNA, 613 bp, Homo sapiens
  misc_feature: GZ8MTXP01ADGML.15.28.C06.1.454.CMB.2.raw
  modified_base (372)..(372): a, c, t, g, unknown or other
  modified_base (492)..(492): a, c, t, g, unknown or other
  modified_base (512)..(512): a, c, t, g, unknown or other
  modified_base (523)..(523): a, c, t, g, unknown or other
  modified_base (554)..(554): a, c, t, g, unknown or other
  modified_base (603)..(603): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggagcctcgtccaggccggggggtcctgagactctcctgtgaagcctctggacttcaccttgacgctactttagttggatggacgttgggtccgccgaggcctcccggagggggaaggggcgtgggaggtgggtggccaaccgataacaaaagntacggaagtgacacaaacctagtagtacgaactctgtgacgtgggccgattccgaccgtctccctcgacgcccctaccgaacccgacgggccccacgttcccgggtccctttacccccgnggtcccgccccgtagtcccnccgagggaccnccgaccgcgacgcgccgacgcggcccggcgnggcctcgccgtacggcacggttccttaccgtccgactaacggtacgcgnggcggcggtg

SEQ ID NO: 400572 - DNA, 863 bp, Homo sapiens
  misc_feature: GZ8MTXP01DMGTB.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctcccgtccacccttgtctgcattctggtcggagacagacgtcaccatcacgttcggccggcagtcagtaagtattactaagtggttgcgtggttacagacaagaacgacggaaacacccgtaaacgtcctagtactctcgtcgccgtcccttcgttaacgtttcgacgtaaacgggtttcgggggtaccctaagttacgtaaggttcacgggtcccggacgtacggtaggtacgttaccggtaacgggggtaactaagggttaaactttaccgaaacgggtttcccctaaccgaacccgtaaacttcccgaaacggttaccgtacccgggacccgtcggtacccggacggtttacccccgttagggggttaaacctttacggttttaaccgtaaacccgttaaaccgttttaacccttacggttaaccggggtaaaccccggttaaaggggttttaaccgaaacctttaaacgttaaaatttaacgtttaaccggttaaaacgggggttttccgggggtaaaccgggggtaaacgggggttaaacccggtaaaggggggttaaacgtaaagttaaaccggtaaaccggttaaaacgtaacggttcgggttacggggttacttacggaaccccttaaacgggtctttaccgggttcgtttaccgtttaaccgtttcccttttaaccccccggg

SEQ ID NO: 400573 - DNA, 590 bp, Homo sapiens
  misc_feature: GZ8MTXP01CKXH4.15.28.C06.1.454.CMB.2.raw
  modified_base (241)..(241): a, c, t, g, unknown or other
  modified_base (243)..(243): a, c, t, g, unknown or other
tcagtctacgtagccacgaccggtgctcgatttagagctcacgtattggggtttgggggagtcgagactcagtcaggacacagcatggacatgagggtcccgctcagctcctggggctcctgctgctctggctccaggtgccaaatgtgacatccagatgaccagtctccgtccacctgtctgcatctgtcggagacagagtcacatcactcgcggcagtcagatatactaatgtgctgtnancagaacaggaacacccaaagtcctagactctctcgcctcctcttacttgacgtaaaggtcgggtcctattaccgtaaaggttcgaacggccggacgtaaggtgtatcggtaagggactaaggtaatttcgagttcctacaacctatacaacgcgtaccgcgtcgacgacgtacgtacgtacgtacgttacgtactaacttactacgtacggtacgtagtactactaataataacgtacgtacggtacggtacgggacgggaacggtaaggtaaggtaacgaacgtaacgaaacgtaacgtcggttacgttcgttacgaactactaactctcgttcttcgttcgtccg

SEQ ID NO: 400574 - DNA, 551 bp, Homo sapiens
  misc_feature: GZ8MTXP01BC2L1.15.28.C06.1.454.CMB.2.raw
  modified_base (436)..(436): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttggccgggccagtcagagtattactaaatggttgctgttcagcagaacaggaaacacccaaagtctgatctctcgccgtcctctacgtttgacgaaacggttcggggtcccatcgaaggttcaggccggcagtggatcgtagggacaaggtaattcgaagtcctcaccatcagcacgcctgcaggcctgacgtatttgactacttactactggacctaagtnactaataataatcgtagttacgggcggaacggtaacgaagggtggaagttacgtaacgaaaccgtagtggttggccttggaaccactaatccgtgttacctcttaacgttccccg

SEQ ID NO: 400575 - DNA, 556 bp, Homo sapiens
  misc_feature: GZ8MTXP01AM74M.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtcaccctgtctgcatctgtcggagacagagtcaccatcacttgccggcagtcagagtatactaaatggtggctggttcagcagaacaggaaagacccaaaagtcctgatctcgtgccgcctcttactttgactaaaggtcggggtaccccagtacgaaggttcaagtccggacgagtggatcgtagggacaagaatcagtctcacatcagcagctgcagcctgacgtatttcgactaacttactactacggaccaaggtcacaattaaatactctaagttcgggacgtaaggggaccaagggtgggaattactaccgaaagtaacgtggttcggcttacggccaacgtaactcttcggttaccttaacgttaaccgttccccg

SEQ ID NO: 400576 - DNA, 608 bp, Homo sapiens
  misc_feature: GZ8MTXP01EDSMN.15.28.C06.1.454.CMB.2.raw
  modified_base (457)..(457): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagatcaccatcacttgccggcagtcagagtattactaaatggttgctggttcagcagaacgaggaaacacccaaaagtccagatctctcgccgtcctacttactttgacgtaaacggttcggggtacccagtacgtaacggttcaggccggcaggtggatcgtaagggaactaaggtaatcgacgtctcaaccatccagcacgctgcagtcctaggtactatttacgactaacttactacgtagggacctaaggttnaactaataaattaacgtcgttaacgttcgggtacgggaacgggaaccgtaagggtaaggaaggttaaactaacgaaaaccggtaagttacggttcggttcttacggaaccctacggtaacttcgtacgttccttaacgttccgtttccccg

SEQ ID NO: 400577 - DNA, 596 bp, Homo sapiens
  misc_feature: GZ8MTXP01CXNI3.15.28.C06.1.454.CMB.2.raw
  modified_base (458)..(458): a, c, t, g, unknown or other
  modified_base (517)..(517): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcacatcacttggccggccagtcagtagtaattactaaatggttgctggttcagcaagaaacagggaaacacccaaagtcctagatctctgcccgctcttactttgactaaagggtcggggtaccctagtacgaaaggttcacggtccggacaggtggatcggtaagggacaagtaaattcagtcctacaaccatcgagcaggcctggacacgcctagacgttatttcgaactaacttactactaggacctaagtnaactaataaactaactcttacgttcggaggtaacgggacgaaagggtcggaaacggttntaaacgaaacgtaacggttgacggttcacggtaaccaccgtaagttccgttacgttccttaaccgttaacgtttccccg

SEQ ID NO: 400578 - DNA, 736 bp, Homo sapiens
  misc_feature: GZ8MTXP01EGCW0.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacagggaaacgcccaaaagtcctagatctctcgaccgcccttcttaacttttgacgtaaaacgggttcgggggtaccccctaagttaccgaaagggtttccgaacggtcccggggaccaagggttggggaattcccgtaagggggaaccaaggtaaatttcccgaaggttccctaccaaccccagttacccaaggccaacggtccccgtaggaccgacggtacccgttaggtaaccgtttacgttttacgaaaccttaaaccgtttacgtaccgttacgggaaccgtaaaggttctaactaaattaaacttaaacgttacgttaacggtttaccggggaacggggtaacggggtaaccggtaaagggggtaaggaaacgttaaacgtaaaccgaaaacggtaacgtacgggttacggttccttacggaacctacctaagttccgttcgttaccttaaccgttaaccgttccc

SEQ ID NO: 400579 - DNA, 647 bp, Homo sapiens
  misc_feature: GZ8MTXP01BV1NW.15.28.C06.1.454.CMB.2.raw
  modified_base (252)..(252): a, c, t, g, unknown or other
  modified_base (279)..(279): a, c, t, g, unknown or other
  modified_base (609)..(609): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagacgtcaccatcacttcggccggcagtcagtatatatagtggtgctgtngcagaacgaggaacacccaaagtcctnatctcgtcgccgtctacgttacgttgacgtaacgggttcgggtaccctagttacggtaaaggttcgacgggtccggacgtaggtggtacgtacggtaagggaacctaaggtaactttccgagttcccctaccgtacacgtacgaccgtacgaccggtccgtcgacgaacgtccgtaggtactttacggtttacaaccttaaccgtttactacgttacggaactaaggtctaactaaacttaatacgttacgttacggtttccgggacggggtaacgggaaccgtaggggtaacgtaagttacgtaaacgaaacgtaacgtggacgttcgngaacccattcgttcttcgttccttcgttcgtttccccg

SEQ ID NO: 400580 - DNA, 593 bp, Homo sapiens
  misc_feature: GZ8MTXP01AULWH.15.28.C06.1.454.CMB.2.raw
  modified_base (350)..(350): a, c, t, g, unknown or other
  modified_base (391)..(391): a, c, t, g, unknown or other
  modified_base (438)..(438): a, c, t, g, unknown or other
  modified_base (571)..(571): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaagtggttggcctggttcagcaagaaaccgagggaaacgaccccaaaagtcctgatctctcgccgcctctacttgacgtaaggtcgggtaccatcgaaggttcgagccggntaggtgagtcgtagggactaagacttcagtctcaccatcancagcctgctacgccgtagtacgtactttacgcctaaacgttactacncgtaaccgtaggtacactaaactaataagttactaggtttaccggacggggaacgggtaaccgaagggtaacggtaaagacgtaaacgaaacgggtacgtgggttacgttcgttacgcctacaacgtttccgngttaccttcaacgtttcccccg

SEQ ID NO: 400581 - DNA, 767 bp, Homo sapiens
  misc_feature: GZ8MTXP01AW21A.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcaagaaaccagggaaacgaccccaaaagtcctagatctctcgccgtcctcttacgtttcgacgtaaaggttcgggggtaccccagttacgtaaacggtttcgaacggtcccggaccgtaagggttcggggaaattccggttaaaggggggtaacccaagggtaaactttcgaaacggttcctacctaaaccaacttcccgaaaggccaaagccccgttcggaccgaggtaccccgttaggtaaaccggttattttttacggaccttaaacctttaaccgttaaaccttacgggtaaccccgtaaaggggttaccgtaacctaaacgtttaaaataaaacggtttctaaacggtttttaccgggggaaccgggggtaaacggggtaacccggaaagggggttaacgggaaagttacgtaaacccggaaaaccggtaaagttcgggttaacgggcttacgggaaccacccgtaagttcccttggttaccctttcgttaacgttttcccccg

SEQ ID NO: 400582 - DNA, 737 bp, Homo sapiens
  misc_feature: GZ8MTXP01BHHRK.15.28.C06.1.454.CMB.2.raw
  modified_base (198)..(198): a, c, t, g, unknown or other
  modified_base (255)..(255): a, c, t, g, unknown or other
tcagtctacgtagccacgaccggtgctcgatttagagctcacgtattgggtttgggggagtcagactcagtcaggacacagcatggacatgagggtcccagctcagctcctggggctcctgctgctctggctcccaggtgccaaatgtgacatccagatgacccagtcctccgtccaccctgtctgcatctgtcgganacagagtcaccatcacttgccggcagtcagtagtattactaaatggtgcctggttcngcagaaacaaggaagacccaaacgtactgatctctgccgtcctctactttgacgaaacgtcgggtaccactactaaggtcgacgcggacgaggtggactacgtagggaacgaaagtaacttacacgtacctactaacccacttaccgacgaccaacggtcccgtacgacgtaccggtacccgttagtaaccggttaacttttacgaacctaaaccgttttaacccttaacggtacggtaaccccgtaaaggttacgtaaactaaaccgttaaaagtttaaacttacccgtttaaacgggttttacccgggggtaaccggggaaaccgggggtaaaaccccggtaaaaggggggtttaacgggaaaggggtaaacttacccggaaaaaaaaccggtaacccggttagggttcggggaccgtaacgggtacccgtaaacccgttaacttccgtttaacggttcccgttttaaccgttaaccccg

SEQ ID NO: 400583 - DNA, 609 bp, Homo sapiens
  misc_feature: GZ8MTXP01BIOS4.15.28.C06.1.454.CMB.2.raw
  modified_base (253)..(253): a, c, t, g, unknown or other
  modified_base (268)..(268): a, c, t, g, unknown or other
  modified_base (376)..(376): a, c, t, g, unknown or other
tcagtctacgtagccacgaccggtgctcgatttagagctcacgtattgggtttgggggagtcagactcagtcaggacacagaatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggtgctggttcagnagaaacagggaaacncccaaaagtcctgactctctcgccgcctcgtactttgacaaaggtcgggtcccagtcgaaggttcagcgcagtgatcgtgggaacagaattcagtctcaccatcgaancagccctgcagcctagacgtattttacgactaacttacactcgaccgaaggttcaactaaagttaaataattaccgtaaggttttaccggggaacggggtaaggggaaacccgtaaaggggttgggaaacgtacgttaaaccgaaaacggaaacgttggtacgggttaccttacggacccaacccgtagttccctttggttacctttcctaacctttcccggtttaacccccg

SEQ ID NO: 400584 - DNA, 604 bp, Homo sapiens
  misc_feature: GZ8MTXP01DXKZO.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagatcacatcacttcggccgggcagtcagtagtaattaactaaagtggttggccttggttcagcaagaaacgagggaaacacccaaagtcctgatctctcgccgtcctctactttgacgtaaaggtcggggtaccctatacgtaaggttcaggtccggactaggtggatcggtaaggggactaagtaaacttcgaacgttcctaccaaccacttacgacgtacgacgccctaggacacgtccgtagtacgttatttcgaactaacttactctcggactagtctaacaattaaatatacgtaacggtttcgggacgggtaaggaccgaaagggtgaaagttactaaacgaaacgtagttggttcgcttgaaccactgttactgttacctttcaaccgttcccc

SEQ ID NO: 400585 - DNA, 571 bp, Homo sapiens
  misc_feature: GZ8MTXP01ALX6O.15.28.C06.1.454.CMB.2.raw
  modified_base (268)..(268): a, c, t, g, unknown or other
  modified_base (389)..(389): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaatggttggctggttcagcagaacaggaanaccccaaagtcctgatctctcgccgcctctactttgacaaagtcggggtacccatacaaggttcaggccggacagtggatcgtagggacaagaacttcgagtctcacatcagcacggtccncgcacgtcgtacgtacgttactttacgaccttaacttaccttacgtacgtaacgtaggtacactaaattaatacttacgtacggttcgggacgggaacggtacgaaggtggaacgttaactaacgaaacgtacgtggcgttcgctaaccacgtcgttctcgttaccttcgttaaccgtcccg

SEQ ID NO: 400586 - DNA, 687 bp, Homo sapiens
  misc_feature: GZ8MTXP01BMCDH.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagtatatactaagtggttgctgttcagacagaacaggaacacccgaaagtcctagactctacgtcgccgtcctcttactttcggacgtaaacgggtcgggtacccatacgtaacggttcgacggtcccggtactaggtggaacgtcggtaaggggaacaagtaacttcgagttcctaccgtacctataccgagccgacgtccgtagaccgtacgtaccgtacggtacgttacgttttacgaccttaaacttacttaaccgtacggaacccgttaaagtacgaaaccttaaattaaacgttacgttaccgttaacggtttaccggggacggggtaacggtaacggtaaggggtaacggaaacgttaacgttaaacgaaacggtaacgttcggttacgggttccttacggtaacccgtacttaacgttacccggttcgttacctttccgttaaccgtttccccg

SEQ ID NO: 400587 - DNA, 698 bp, Homo sapiens
  misc_feature: GZ8MTXP01CLK6P.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcacgttggcccggcagtcagtattattaactaagtggttgctggttcagacaagaaacgaggaaacgaccccgaaaagtcctagactctcgtcgcccgtccttcttacgtttcgacgtaaacgggttccggggtacccctaagtaccgtaaaggttccgaggccccgggtacgaggtacggtagtcggtaaggggacctaagtaaacttcgacgttcctacgaaccctagtaccaagccgtaacgcccgttacggaccgtacgtaccgttacggttaacgttacgttttacggaaaccttaaccgttactacgttccgggaacctaagggtactaacctaaattaaacttaacgtacgttacggttaccgggaacgggtaacgggtaaccgtaagggtaacggaacgaacgttaaaccgaaacgtaacgtggttacggttcacgtaacccaactcgtccttacgttccttaaccttaacgtttccccg

SEQ ID NO: 400588 - DNA, 659 bp, Homo sapiens
  misc_feature: GZ8MTXP01B9CZW.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctggtcggagacagagtcaccatcacgttcggccgggccagtcagtagttattaactaagtggttggccttggttcagacaagaaaccgagggaaacacccaaaagtcctagatcctcgtcgccgtcctcttactttgacgtaaagggttcgggtaccctagtacgtaaggttcgacggccggcgaggtggatcggtaagggaacaaggtaacttcacgtcctacaacctatacacggacacgtccgtacgaccgtacggtaccgttacgtaacgtttatttacgaacctttaaacttacctaccgtacggaaccgtagtctaactaaattaaattacgtacgtttacgggttacggggacgggtaacggtaaccgggtaagggaagggtaattaaacggtaacgaaacggtacggtcgttacggcttacgaaccactaattccgtcgttcctaacgttccttccccg

SEQ ID NO: 400589 - DNA, 530 bp, Homo sapiens
  misc_feature: GZ8MTXP01DL22E.15.28.C06.1.454.CMB.2.raw
  modified_base (272)..(272): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccgggccagtcagagtattactaaatggttggcctggttcagcagaacagggaaanaccccaaaagtcctgatctctgccgcctctactttgacaagtggggtcccatcaaggttcagccggcaggtggatcgtagggacaaggaaattcagtctacacatcagcagcctgcagcctgacgtatttgactaacttactactggaccctaagttgacaataatattctagtttcggacgggaaggaccgaaagggtggaagatacgaaacgtaactggttggcttaggccacaattctgttcttcgaactttccc

SEQ ID NO: 400590 - DNA, 600 bp, Homo sapiens
  misc_feature: GZ8MTXP01BCFLC.15.28.C06.1.454.CMB.2.raw
  modified_base (548)..(548): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctcccgtccaccctgtctgcatctgtcgagacagagtcaccatcacgttcggccggcagtcagtatatactaagtggtgctgtcagcaagaacgaggaaacacccgaaatcctagactctctgtccgccttcgtactttgacgtaaaggtcggtaccatcgtaaggtcgaggccggacgtaggtaggactcggtaagggaactaaggtaactcgacgtcctacactactcaagccacgctaggcctagcctaggtacgttatttacgaccttaatacctacgtggactaaagctataaactatacgttacgagttccggggaggaacgggacggtaaggaagggaacttaacgtaaaccggaaacgtaagttcggggngttccaggaacccctagtaacttcgttaccttactccgttaacctttccccg

SEQ ID NO: 400591 - DNA, 692 bp, Homo sapiens
  misc_feature: GZ8MTXP01BFNUY.15.28.C06.1.454.CMB.2.raw
  modified_base (196)..(196): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcganacagatcacatcacttcgccggcagtcagatattactaatggtgctgttcagcagaacgaggaacacccaaagtcctagatctctcgccgtcctacttacttgacgtaaaggtcggggtcctagtacgaaggttcgacggaccggtcaggtaggtatcgtaacggggaacctaagtaacttacgacgtacctacaacccgtagtaccagccgaacgcccgtgaccgacggtacctaggtaacgttacgttttacgaaccttaaactttaccttaaccgttacggggaaccctaaaggttacaaccttaaattaaaacttaacgtacgttaacgggtttccggggaaacgggggtaacgggtaaccggtaaaggggttaagggaaacgttaaacggtaaaccgttaaaacccggtaaggtcgggttacgggttcttacccgggaaccctacggtaactttccgtcggtttaacccttccgttaaccctttcccccgg

SEQ ID NO: 400592 - DNA, 618 bp, Homo sapiens
  misc_feature: GZ8MTXP01AO5C6.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcacttcggccggcagtcagagtattactaagtggtggctggttcagacaagaaaccgagggaaacaccccaaaagtcctagactctctcgcccgtcctacttactttcgacgtaaacggtcggggtaccattacgaaaggttcgaggtccggacgtaggtggtactcggtaaggggaactaagtaacttcgagtcctacacatccagcgacgccgtagacacgccgtagacgttatttacgacttaacttactacgtacggacctaaggtcaactaattaaatactacttacggtttcgggacgggtaacgggaaccgaaagggtaacggaaagacgtaaacgaaacggtacgtggttacggcttacggaactaccgtaatcgttcttaccttcgttaacgttccccg

SEQ ID NO: 400593 - DNA, 619 bp, Homo sapiens
  misc_feature: GZ8MTXP01DWS9Z.15.28.C06.1.454.CMB.2.raw
  modified_base (328)..(328): a, c, t, g, unknown or other
  modified_base (351)..(351): a, c, t, g, unknown or other
  modified_base (498)..(498): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccgggggggtcctgagactctcctgtgaagcctctggattcaccttgagcacttattggatgacttggccgcaggctcgaggggaggggctggngtgggtcgccacataacaaaagntaggaagtgaacacaaacctatagtagaactctgtgagtggggccattccaccgtctcctcacgccctacccgaaccgaacgggcccctacgtcccgggtcccttccccccgtgggccccgtcccgtcgccgttcccgaacgggacncccgacccgtccggaaacggcgtccaacgcggcccggggcccttgggggctcggccgttgggtaccaaacgggttccttaacgttcccggacttaacggtacgcgttggaacggcgggtcg

SEQ ID NO: 400594 - DNA, 661 bp, Homo sapiens
  misc_feature: GZ8MTXP01CK2VT.15.28.C06.1.454.CMB.2.raw
  modified_base (349)..(349): a, c, t, g, unknown or other
  modified_base (560)..(560): a, c, t, g, unknown or other
tcagtctacgtagccacgaccggtgctcgatttagagctcacgtattgggtttggggggaagaggaagactgaaggcctttccacttggtgatcagcactgagcacagaggactcaccatggaattggggctgagctgggttttccttgttgctattttagaaggtgtcagtgtgaggtgcaactggtggaggtcgtggggggagcctcggtccgaggccgggggggtcctgagactctcctgtgaagcctctggattcacttgagctattagtggatcgacgttgggccgcgaggctaccgaggggaggggctggaggtgggtcggcccaacaagtaaacaaaaaagngtaggaaagtcgaacaactaacctatgtacgaaaccctcgtaggtgagtcggggacctattcccaccgttctaccgaggagaccgaacgaccaaacgaaccactaactacattcgacgtaacaaacgtacgaaacaacccaggaacgagaccgggaaggaaccgtacggtctagtagttactagtgtggtgtaagtgtacgttgttacggngggttaccggttggggacccgtaacggggaccccgttggacccgttaacccgtcctcccgtaaccaccggttcccctaacccgaacccggtaaccccgggg

SEQ ID NO: 400595 - DNA, 907 bp, Homo sapiens
  misc_feature: GZ8MTXP01COBCF.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctcccgtccaccctgtctgcatctggtcggagacagacgtcaccatctacgtcggccggccagtcagtagtattactaagtggtgtcttggttcagacaagaaccgaggaaacgacccgtaaagtcctgactcctcgtcgtcccgtccttacttacgtttacggacgtaaacgggttcggggtaccctagttacgtaaacggttcgaacggccccggtacggtagggtcgggtaacgttaccgggtaaacggggtaaactaacggttaaacgtttaccgtaaccgggtttacctaccccaaacccgtaacgttacccgtaaccgggaccgtaacccggtcccgttacggaaacccgttaccgggtacccggtttaacgggttaaacccggttttaacgttttaacccgggtaaaccccgtttaaaaccccttttaacccggttaacccggtttaacccggggtaaaccccgggtaaaacggtttaccggtaaacccgtttaaaatttaaaaccccgttaaaccggtttaaccggttaaccggggttttaaaccggggggtaacccggggttaaacgggggtaaacccgttaaaggggggaaccggtaaacggttaaaccgtaaaaccgggaaaaccgggtttacggttacggggttacccggttacggttacgtaaccccgtacctttcgttacccggttttacgttaccccgtttaacgttcccgtttaacccccgg

SEQ ID NO: 400596 - DNA, 574 bp, Homo sapiens
  misc_feature: GZ8MTXP01CRE4P.15.28.C06.1.454.CMB.2.raw
  modified_base (450)..(450): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcacatcacttgccggcagtcagagtattaactaaagtggttggctggttcagcaagaaaccaggaaacgacccaaaagtcctgatactctcgcccgccttctaactttgacgtaaaaggtcgggggtaccagtacgaaacggttcaaggccggcgagtggaatcgtaagggacaagaattcagtctcaaccatccagcagctgcagcctagactatttgactaaacttactactgggacctaaggtnacaataaacgtaatctaacgttcgggaggaaggggaaccgaagggtaagaagaactaacgaaacgtaaacgtggttcggcttacggccaaacccgttcttcttcgttaccttcgttcgttcccg

SEQ ID NO: 400597 - DNA, 720 bp, Homo sapiens
  misc_feature: GZ8MTXP01C4MMC.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagacgtcacatcacttcggccggcagtcaagtagttattactaaagtggttcggcttggttcagacaagaaaccgaagggaaacgacccaaagtcctagactctctcgcccgtccttacttacgtttcgacgtaaacgggttcgggaccctagttacgaaggttcaaggccggtacgtaaggtggaagttcggtaaacggggaactaaggtaactttacgacgttacctaccaacctagtacacgacaccggtctcggacctacggtcccgttaggtaacttacgttttaccgaaccttaaaccgtttactaaccgttacgtaaccggtaaacgttacgtaacttaaactaaacttaacgttcggttaaacggtttccgggggaaccggggtaacggggaaaccgggtaaaggggtaacggaaacgttaaacgtaaaccggaaacggttaacgtgggttacggttcttacgggaaccctaacttcgttcttcgtttaccttcgttaaccgtttcccccg

SEQ ID NO: 400598 - DNA, 535 bp, Homo sapiens
  misc_feature: GZ8MTXP01DA320.15.28.C06.1.454.CMB.2.raw
  modified_base (141)..(141): a, c, t, g, unknown or other
  modified_base (254)..(254): a, c, t, g, unknown or other
  modified_base (269)..(269): a, c, t, g, unknown or other
  modified_base (338)..(338): a, c, t, g, unknown or other
  modified_base (344)..(344): a, c, t, g, unknown or other
  modified_base (355)..(355): a, c, t, g, unknown or other
  modified_base (359)..(359): a, c, t, g, unknown or other
  modified_base (363)..(363): a, c, t, g, unknown or other
  modified_base (369)..(369): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtnccaaatgtgacatccagatgacccagtctcccgtccaccctgtctgcatctgtcggagacagagtcacatcacttcgccgggcagtcagagtattactaaatggttgctgttnagcagaacaggaaancccaaaagtcctagatctctcgcgcctctacttgacaagtgggccatcaagtcagccgacagtgatcgngggacngattcagttcncacntcancagtcngcacgtctgtacttacttacactacttactctacggactaagtacaactaataaatatacgttacggttacgggacggtaacggaacgaagggtaagaacgaacgtaacgaaacgtacgtggttacgcttacgaacctacgtctcttacgttcttcgttcttcccg

SEQ ID NO: 400599 - DNA, 655 bp, Homo sapiens
  misc_feature: GZ8MTXP01COS72.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccggcagtcagagtattactaatggttgctggttcagcaagaaccaggaaacgacccaaaagtccctagatctctcgcccgtccttcttactttgactaaagggttcggggtacccagtcgaaaggttcaggcccggcaggtggatcgtagggacaaggtaacttcagtctacacatcagcacgctgcagtcctgtacgtattttcgactaaactttactaacctcggaaccctaaagtgaacctaaattaaacttaaactcgtaaacggttttccggggaacggggtaacggggaacccgtaaagggggtcgggaaacggaaacgttaaaccgaaaacgggtaaaccgttggggttaaccgggcgttacgggtaaccctaaccccgttaagttcccgttaacggttcccttttaaccttaacccggttttaacccccg

SEQ ID NO: 400600 - DNA, 580 bp, Homo sapiens
  misc_feature: GZ8MTXP01BB7KA.15.28.C06.1.454.CMB.2.raw
  modified_base (301)..(301): a, c, t, g, unknown or other
  modified_base (354)..(354): a, c, t, g, unknown or other
  modified_base (386)..(386): a, c, t, g, unknown or other
  modified_base (478)..(478): a, c, t, g, unknown or other
  modified_base (505)..(505): a, c, t, g, unknown or other
  modified_base (520)..(520): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccgggggggtccctgagactctcctgtgaagcctctggattcaccttgagcactatggatgacttgggccnccaggcctccgaggggaaggggctgggagtgggtgccaccgaataacaaaagntaggaagtgacccacaactatgtagaaacctntgtgacgttggggaccgtatttccaccgttctcccaggacgaaccggacgaccaaacgactacactacacttcagacaaatggaaactaccngaagacgccgagaccgacggtctggtntatcgtgtgttgagngtatgttcgttggcggttcggggcgaacgggtacccgtggacctaacccggttctccccg

SEQ ID NO: 400601 - DNA, 749 bp, Homo sapiens
  misc_feature: GZ8MTXP01B44KR.15.28.C06.1.454.CMB.2.raw
  modified_base (293)..(293): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagacgtcacatcacgttcgccggcagtcagtagtattactaaagtggttgtctggttcagacagaacgaggaacacccaaagtctagatcnctcgccgtcctacttacgttgaccgtaaggtcggggtacccagttaccgtaaggttcgacggccggacgtaggtcggtacgtcggtaagggaactaaggtaaactttcgaacgttcctaccacctaacgtaccgagtaccgacgtcccgtggacctacggtccgttacgtaacgtttacgtttaccgaacttaaacctttaccgtacgttacggtaccgtaaaggttactaaccgtaaattaaaacttaacttacggttaaaccgggttttccggggaaacgggggtaaccgggtaaaacccgggttaaagggtaacggggtaaacgttaaaccggtaaacgttaaaaacccgggtaaacgttacggggttacggaccgtttaccggaacccttaacccttaacggttacccgtttacgttccccttttaacttaacccccgggtttttaaccccg

SEQ ID NO: 400602 - DNA, 597 bp, Homo sapiens
  misc_feature: GZ8MTXP01BMHAF.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagatattactaatggtgctggttcagcagaacaggaaacgacccaaaagtcctgactctcgcgccgcctctactttgactaaaggtcggggtacccatcgaagtttcgaggccggcagtacggatcgtagggacaagatcagtctcaccatccagcacgtcctgcgacgtcccgtagtaccgttacttttcgaccttaaactttacgtaccttcggacctaaagtcgactaaattaactaatcgtagtttcgggaccgggtaacgggaaccaaaggggtcggaagttaacgtaaccgaaacggtaacgttcgttaggttcttacggaacctaccgtaagttccttcgttaccttaacgttaacctttccccg

SEQ ID NO: 400603 - DNA, 541 bp, Homo sapiens
  misc_feature: GZ8MTXP01E12TE.15.28.C06.1.454.CMB.2.raw
  modified_base (274)..(274): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaanaccccaaaagtcctgatctctgccgcctctactttgcaaagtcggggtcccatcaaggttcagccggcagtggatcgtagggacaagaatcagtctcaccatcagcagcctgccagccctgaccgtatttcgactaacttactacgtgaccaaagtgacaataataatctagtttaccgggcgggtaaggggacccaagggtcgggaagttacacaaaacgacgtgttcgggcttcggcacctaatcctgttccttcaacttccccg

SEQ ID NO: 400604 - DNA, 673 bp, Homo sapiens
  misc_feature: GZ8MTXP01DZRW3.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtctccgtccaccctgtctgcatctggtcggagacagatcacatcacgttgccggcagtcagtagtaattactaaagtggttgctggttcagacaagaaacgaggaaacgacccaaagtcctagactctctcgcccgtcctcttacgtttacgacgtaaacgggtcggggtaccctagttaccgaaggttcgacggaccggcgaggtggatcggtaagggaactaaggtaacttcacgtcctacaactactacacgcgtacgccgtagacctacggccttaggtacgttacttttacgaaccttaaaccttaacgttaccgtacgggtaacccgtaaaggtactaaccttaaataaacttaacgttacgttaacgggtttaccgggggaacggggtaaacgggtaaccggaaaggggtaaggtaaacgttaagtaaacgaaaacggtaacggtcggttacgcgttacgaacctacgtaacttcgtcgttccttaacttcgtttccccg

SEQ ID NO: 400605 - DNA, 666 bp, Homo sapiens
  misc_feature: GZ8MTXP01D79VU.15.28.C06.1.454.CMB.2.raw
  modified_base (201)..(201): a, c, t, g, unknown or other
  modified_base (447)..(447): a, c, t, g, unknown or other
  modified_base (646)..(646): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatcgtggtcgganacagactcacatctacgttcggccggacagtacagtaagttaattaactaaagtggttcgcgttgtcagacaacgaaacgaaggaaacaccgtaaagtcagactctcgtcgccgtccttacttacgttagaacgtaaacgggttccgggtacctaagttacgtaaggtcgacggcccggtagtacggtgtactacggtaaacgggaactaaggtaatcgacttccacactagtacacgacgacgcngacgtacgtaccgttaggtaactttagttaccgaaacttaaccttactaacgtacggtaaacgtaaggtacctaaactaaattaaacttacgtacggttaacggttacgggggaacgggtaaacggtaacggtaaggggtaaggaaacttaacgtaaaccgaaagtacgtggttacgttcacgtaacacttgttacgtnttcctaacgttctttccccg

SEQ ID NO: 400606 - DNA, 612 bp, Homo sapiens
  misc_feature: GZ8MTXP01BMPOQ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatcgtgtcggagacagagtcacatcacttgccggcagtcagtatatactaaatggttgctggttcagacaagaaccaggaaacacccgaaaagtcctgatctactcgccgtccttacttacgtttgacgtaaaggtcgggtaccctagtacgaaaggttcgacgccggacaggttggagtcgtaagggaactaagtaaactttcgacgtctcgaacactcagtcgagcccgtgaccagtcccgtagtacgttactttcgaactaacctttacgaccgttaggaccctaagtcaactaaattaaactaattacgtaaggtttcgggacgggaaacgggtaccaaaggggttaaggaacttaagtaaccaaaggtactggacggttcttacgaacctacaattcgtcgttacttcgttaagttcccc

SEQ ID NO: 400607 - DNA, 610 bp, Homo sapiens
  misc_feature: GZ8MTXP01AEC4N.15.28.C06.1.454.CMB.2.raw
  modified_base (289)..(289): a, c, t, g, unknown or other
  modified_base (434)..(434): a, c, t, g, unknown or other
  modified_base (579)..(579): a, c, t, g, unknown or other
  modified_base (586)..(586): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatcgtgtcggagacagagtcacatcacgtgccggcagtcagtatatactaagtggtgcttggttcagcaacgaaaccgaggaaacgacccaaagtcgtanactcctcgtcgccgtccttacttacgtttgacgtaagggtccgggtacctagtacgtaaggttcgacggtccggacgtacggtggtacgtcggtaacgggaactaagtactcgacgtctacctacgataccgacgtcacgtccgngcgacgtacgtagtatacgtttacactaacttactacgtcggacgtaagtcactaataacgtatcgtacggtcggacggtaaggacgtgggtaacgaagttataaaccgaaacgtcggtacgttcgggcttacggtcctaacgtnttccgtnttcccttaacgttaaccttccccg

SEQ ID NO: 400608 - DNA, 740 bp, Homo sapiens
  misc_feature: GZ8MTXP01CJKGS.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagacgtcaccatcacgttcggccggcagtcagtagtattaactaagtggttggcctggttcagcaagaaccgaggaaacgacccaaaagtcctagactctctcgcccgtcctacttacgttcgacgtaaagggttccggggtaccctagtacgtaaacggtttcgaacggtcccggacgtaggtcggtacttcggtaacggggaacctaagtaactttacgaacgttctaccaaccgtactaccgaacgccgtaacggtcctcggacctacggtcccgttaacggtacggtttaacgtttttaccggacctttaaaaccgtttaccgttaaccgttacggggtaaccccgttaaagggttaccgtaaccgttaaaatttaaacgttaaccgttaacggttaaccggttttacgggggaaccggggtaaacggggtaaaccggtaaaggggtaacggtaacgaacgttaaacgaaacggtaacgttggttacggcttacgaaccacgttaactcttcgttaccttccttaacgttccccg

SEQ ID NO: 400609 - DNA, 561 bp, Homo sapiens
  misc_feature: GZ8MTXP01ANUJA.15.28.C06.1.454.CMB.2.raw
  modified_base (412)..(412): a, c, t, g, unknown or other
  modified_base (432)..(432): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccggcagtcagagtattactaaagtggttggcctggttcagcaagaaaccagggaaacgaccccaaaagtcctagatctctgcccgctctactttgacaaaggtcggggtcccatcgaaggttcagtcccggacaggtggatcgtaaggggacaaggtaatcagtctcaccatcaagcagctgcagtcctgactntttacgactaacttactacngggacctaaggtcactaataagtatctaagttcgggacggaagggtaccgaagggtaaggaagaactacgaaacgtaacggtggttaggcttcggccactaactcggtcttacttcgaacgtttccccg

SEQ ID NO: 400610 - DNA, 578 bp, Homo sapiens
  misc_feature: GZ8MTXP01AC1O0.15.28.C06.1.454.CMB.2.raw
  modified_base (390)..(390): a, c, t, g, unknown or other
  modified_base (430)..(430): a, c, t, g, unknown or other
tcagtctacgtagccacgaccggtgctcgatttagagctcacgtattgggtttgggggagtcagactcagtcaggacacagaatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtgcctgttcagcagaacgaggaaagcccaaaagtcctagatctctcgcccgtcctcttactttgactaaaggtcgggtacccagtcgaaggttcagcggccaggtggatcgtgggaacagtaattcagtctcacatcagcagcctgcancctagacgtatttcgactaacttactactgacctaaggtnacaattaataatccgtaagtttccggggacggtacgggaaccgtaagggtggaagaacgttacgaaaacgaccgtttacgggaagggttcccgttcgacctaacctagttccgttcgttaccttacctaaccgtttccccgtaacccg

SEQ ID NO: 400611 - DNA, 623 bp, Homo sapiens
  misc_feature: GZ8MTXP01DN728.15.28.C06.1.454.CMB.2.raw
  modified_base (251)..(251): a, c, t, g, unknown or other
  modified_base (293)..(293): a, c, t, g, unknown or other
  modified_base (353)..(353): a, c, t, g, unknown or other
  modified_base (458)..(458): a, c, t, g, unknown or other
tcagtctacgtagccacgaccggtgctcgatttagagctcacgtattgggtttggggggaagaggaagactgaaggcctttccacttggtgatcagcactgagcacagaggactcaccatggaattggggctgagctgggttttccttgttgctattttagaaggtgtccagtgtgaggtgcaactggtggagtcgtgggggaggcctcgtccgaggccggggggtccctgagactctcctgtgaagcctntggattcaccttgagtctacttagttggatgacgttgggccncaggctaccgagggggaagggcgtgggaggtggggtcgacccaaccaataaacaaaaagntaggaatcgaacacaacctatgtagaacctcgttgtagagtcgggaccctattccaccgtctaccgagagacgacgacaagactcaactacatcgtagactaaanacgaacaaccgtgaagacgacggggagtaacgacgtacgtgttgttactttagtgtagtgagtagtagttgttcgttggccggggtttcgggccgtaacggggacccgttcgggttccctaacccggtccttccctcaccgccctaacccgaacccgtaaccggg

SEQ ID NO: 400612 - DNA, 606 bp, Homo sapiens
  misc_feature: GZ8MTXP01CSFD6.15.28.C06.1.454.CMB.2.raw
  modified_base (573)..(573): a, c, t, g, unknown or other
  modified_base (583)..(583): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacgtgccgggcagtcagagtattactaaatggttgcgtgttcagacaagaaccgaagggaaacaccctaaaagtcctgactctctcgcccgtacctcttacgttgacgtaaacggttcgggaccagttacgaacggttcaggccggacgaggtggaacgtcgtaagggaacaacgtaaatccgagttcacactatacacgacacgcgtgcaacgccgttagacggttatttacgaccttaaacttacctaacgtacgtaccgtaagttaacataaacttaaataacgttacgtaaggttcgggaacgggtaacgggtaccggaaagggtaagtacgattaacgaaacgtaagtcgttagnttacgcactntctattctaacgttcttaacccg

SEQ ID NO: 400613 - DNA, 529 bp, Homo sapiens
  misc_feature: GZ8MTXP01EAB1M.15.28.C06.1.454.CMB.2.raw
  modified_base (350)..(350): a, c, t, g, unknown or other
  modified_base (497)..(497): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaaccaggaaagccccaaaagtcctgatctctgccgcctctactttgcaaagtgggtccatcaaggttcagcggcagtggatctgggacngaatcagtctcacatcagcagcctgcagctgacgatttgtcaacttactactggaccaagtagacataaataaatactaatttcggtccgggagggggaaccgaaagggtaagggaagggaatacaaaaccgaaacgtaagttgggnttcggcaccaactcttcgttcttcttaactcc

SEQ ID NO: 400614 - DNA, 632 bp, Homo sapiens
  misc_feature: GZ8MTXP01EIK87.15.28.C06.1.454.CMB.2.raw
  modified_base (199)..(199): a, c, t, g, unknown or other
  modified_base (502)..(502): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagatcacatcacttgccggcagtcagtagtattaactaaagtggttggcctggttcagcaagaacgaggaaacacccaaaagtcctgatctctcgccgtcctctactttgactaaacggtcgggtacctatcgtaacggttcacggtaccggcgtagtcggattacgtaacggggaacaaggtaaattcgaaacgtcctaccaaccctagtaccgaacgcgaacgccgtcgacctacgtaccgttacgtaacgttacgttttcgaacctaacttaaccttacgtacggtactaacggttanacttaaataataactcgtaacgtttcgggaacgggtacggaacgaaaggtcgaaagttactaaacgaaacgtagtaggttcggcttacgctaacctaagttcctacgttacttaaccgttcgtttccccg

SEQ ID NO: 400615 - DNA, 579 bp, Homo sapiens
  misc_feature: GZ8MTXP01CS8IZ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaagtggtgctggttcagcagaaccgaggaaacgacccaaagtcctgactctctcgccgccttcttactttgacgtaaaggttcggggtacccagttacgaaggttcgacggccggcaggtggatcgtaagggacaagtaattcgagtctccacatcagcacgcctgcagcctgtacgtatttcgactaacgttactacgtcgactaagtgactaataatatacgtagtttcgggagggtacggaccgtaagggtaacggaagaacgtaaccgaaacgtaacgtgggttacggcttacggccctactaagttccgttagttacctttccgttaacgtttccccg

SEQ ID NO: 400616 - DNA, 810 bp, Homo sapiens
  misc_feature: GZ8MTXP01DLFP8.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcacatcacttggccggcagtcagatatactaagtggtgctgttcagacaacgaacgaggaaacacccaaaagtcctagactctcgtcgcccgtccttacttactttacggacgtaaacgggttccgggggtacccaagttacgtaaacgggttcgacgggtcccgggacgtaagggtacgggtaacgttccgggtaaacgggggtaactaacggtaaactttaccgtaccggttaccctacccaaacctaacgtaccgaacggtacccaaacggtcccgtaggacccgaccggtacccgttacgggttaaccggtttaactttttaccggaacccttaaaaccgtttaacccttaaaccggttaccgggtaaacccgtaaacgggttaccgtaaaccttaaaagtttaaaaccttaaacgtttaccggtttaaccggggtttacccgggggaaccggggtaaaccgggggtaaacccggtaaagggggttaaggaaacgttaaacgtaaaaccggttaaaaccgtaaacggttcgggttacgttcgttacgaaccctaaaccgttcgtttaccttcggttacctttcccgttaaccttttcccccg

SEQ ID NO: 400617 - DNA, 850 bp, Homo sapiens
  misc_feature: GZ8MTXP01BWQ1X.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagagtattactaaatggtggcctgttcagcagaaccgagggaaacgacccaaaagtcctgactctctacgccgtccttcttacttttcgacgtaaacggttcgggggtacccctagttacgtaaacgggtttcgaacggtccccggggtcctaaagggttcgggaacgtttccggttaacgggggaacctaagggtaaaacttttcccgaaacgggtttccctttaccccgaaacccgtaactttacccggaaacggcccgaaaccgggtcccctttaacggggccctaaacgggtcccccgttaagggttaaaccccggttaagtttttttaccggaacccgtttaaaacccgtttttaaccttacccgtttacgggggaaccccttaaacggggttagtaaacccttaaagtttaaaactttaacgtttaaccgttaaaacggtttttccgggggtaaaccggggttaacggggaaacccgtaaagggggtaagtaaacggttaacgttaaaccgaaaacggttaaaccggttaagggttccggggttacttaccgggaaccctaaaccccggttaacgtttaccgttacgtttaccctttaaccgttaacccgtttccccg

SEQ ID NO: 400618 - DNA, 734 bp, Homo sapiens
  misc_feature: GZ8MTXP01A8K62.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgagacagagtcacatcacgtgccggcagtcagtagttattactaagtggttggcttggttcagcaagaaacgaggaaacgacccaaagtcctagatctctcgccgtctctactttacgacgtaaacggtcgggtaccagtcgtaaaggttcaacggtccggacgtaggtcggtactacggtaacggggaacctaagggttaactttaccgtaacggttacccttaccgaacctacgttaccccgaaagcccgtaacggtccccgttaacggccgtaaaccggttccccggttacggtttaaccgtttaacggtttttaacccgaaccgttaaaaccctttaccttaccggttacggaaccccggttaaaggtacgtaaaccttaaattaaacgttaaacttcggttaaacgggtttaccgggggaacgggtaacgggtaaacccggtaaagggtcggtaaagaacgttaaaccgaaacgtacggtccggttagccgttacgaaccacgtaactcgttcgttaccttcttcgttaaccccg

SEQ ID NO: 400619 - DNA, 599 bp, Homo sapiens
  misc_feature: GZ8MTXP01AP79D.15.28.C06.1.454.CMB.2.raw
  modified_base (176)..(176): a, c, t, g, unknown or other
  modified_base (224)..(224): a, c, t, g, unknown or other
  modified_base (288)..(288): a, c, t, g, unknown or other
  modified_base (423)..(423): a, c, t, g, unknown or other
  modified_base (584)..(584): a, c, t, g, unknown or other
  modified_base (586)..(587): a, c, t, g, unknown or other
  modified_base (589)..(599): a, c, t, g, unknown or other
tcagtctacgtagccacgaccggtgctcgatttagagctcacgtattggggtttggggggggtccctgagactctcctgtgaagcctctggattcaccttgagcacttattggatgacttgggtccgccaggctccgagggaaggggctggagtgggtggccaccatacaaaaagntggaagtgacacaacctatgtgaactctgtgatgggcattcaccgtcncagagacgacgccaagactcactacatctgacaaatgaaacaccgtgagagccgaggacacggntgtgtattacgtgttgtggagagtagttcgttctgggtcggttgggggacccaacgggggtaacccctgggtccaccggtctcctcgacgcctaccgaaccgaacgggcccctagtcccggttccctacccccgnggcccgccctggccctacgacggacgccaccgtacggaacgcgtaccaacgcggcccggacccgttgggccctcggtccccgtagggggttacgaacgggtacttaaccttccggagtaccgtagaccgtgggacggcgggctgggccgaagggctagagngnngnnnnnnnnnnn

SEQ ID NO: 400620 - DNA, 697 bp, Homo sapiens
  misc_feature: GZ8MTXP01EKU64.15.28.C06.1.454.CMB.2.raw
  modified_base (470)..(470): a, c, t, g, unknown or other
  modified_base (503)..(503): a, c, t, g, unknown or other
  modified_base (665)..(665): a, c, t, g, unknown or other
  modified_base (672)..(672): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctcccgtccaccctgtctgcatctgtcggagacagatcaccatcacgttcggccgggccagtacagtagtattaactaagtggtgctgttcagcaagaaccagggaaacacccaaaagtcctagactctctcgccgtccttacttacgtttcgacgtaaacgggttcgggggtaccccagttacgtaaacgggtttcgacgggtcccgggacgtacgggtggggtaactccggttaacgggggaaactaaggtaaactttccgaagttccctaccaacccagtaccgacgacgaacggtccncggccagtcccgttaggtaacttacggttttanaccctaaactttaccgtaacttacggggaacctaaggttaccaattaaattaaaactacgttacgtaaacggtttcgggaccggggtaaagggaccgtaaaggggaagtaaagacgtaaacttaaacggaaccggttgttacgggcttaggaacctaacctnttccgtnttaccttaacgttaacgtttccccg

SEQ ID NO: 400621 - DNA, 659 bp, Homo sapiens
  misc_feature: GZ8MTXP01AJ91S.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacgttcggcccggcagtcaagtagtattactaagtggttggtcctggttcagcagaaccgagggaaacacccaaagtcctagactctctcgcccgtcctctactttcgacgaagggtcgggtaccagttacgaaggttcaggccggacaggtggacgtcgtaaggggaactgtaacttcgagtcctacacccatccagtaccacggcctcgaccgacgtaccgtagtaacgttacgtttttacaaccttaaactttaccgtactcgggtaactaaacggttcaacttaaataaacttaacgtacgttacgggtttccgggaacggggtaacggggaaaccgtaaggggttaacggaacgttaaacgtaaaccggaaacgtaaacgtcgggttaggttccttcggaacctaccaatttccgtacgtttcctaaccgttctttccccg

SEQ ID NO: 400622 - DNA, 543 bp, Homo sapiens
  misc_feature: GZ8MTXP01AOUFZ.15.28.C06.1.454.CMB.2.raw
  modified_base (197)..(197): a, c, t, g, unknown or other
  modified_base (270)..(270): a, c, t, g, unknown or other
  modified_base (280)..(280): a, c, t, g, unknown or other
  modified_base (287)..(287): a, c, t, g, unknown or other
  modified_base (382)..(382): a, c, t, g, unknown or other
  modified_base (438)..(438): a, c, t, g, unknown or other
  modified_base (443)..(443): a, c, t, g, unknown or other
  modified_base (465)..(465): a, c, t, g, unknown or other
  modified_base (514)..(514): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacgttgccggcagtcagtagtatactaagtggttggcctgttcagcagaacgaggaaacncccaaagtcngatctcngccgctctactttgactaaagtcgggtacccatcgtaaggttcaggccggcaggtgatcgtaagggactaagaattcacgtctcacatcagcacncctgcagcctagtacgtactttcgctaacttactacgtggaccagtcactaattanacttntaagttcggcggaggtaaccgngggtaagacgaatacgaaagtacgtggttcggcacggaacctaaccgtnttctacgttacttaacgttaaccttcccg

SEQ ID NO: 400623 - DNA, 799 bp, Homo sapiens
  misc_feature: GZ8MTXP01DVAYY.15.28.C06.1.454.CMB.2.raw
  modified_base (245)..(245): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctccaggtgccaaatgtgacatccagatgacccagtctccgtccaccctgtctgcatctgtcggagacagagtcacatcacttgccggcagtcagatattactaatgtgctgttnagcaagaaccgaggaaacgacccaaagtcctagactctcgtcgccgtcctacgttacttcgaacgtaaacgggttccgggtacctagtacgtaacggttacgaacggtccggacgtaggtacggtacgtttacgggtaaacgggaacgtaacggttactttaccgtaaaccggtttcctaaaccgaacccgtacttaaccgacgggtacaacccggttcgtaccgggacctaaccggtacccggttagggttaaacctttaggttttaaccgaaccgtttaaaccgtttaacccttacggttaaaccgggtaacccgttaaacggttagtaaacccttaaagttaaacgtaacgtttaccggttaaacggggtttcccgggggaaccggggttaaaccgggggtaaccggtaaacgggggaaggttaacggggaaacttaaaacccggttaaaaggtaaaccggtttgggaaaccgggttcgttaccgaacccgttaaaccctaaggttttacgttacccgtttcgttttaaccgttaacccgtttttcccccg

SEQ ID NO: 400624 - DNA, 662 bp, Homo sapiens
  misc_feature: GZ8MTXP01AS56I.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaagtggttgctggttcagcaagaacgaggaaacgacccaaagtcctagatctctcgcccgtcctcttactttcgacgtaaacgggtcggggtccagttacgaaggttcgacggccggcgtaggtggactcgtagggaacaaggtattcagtcctacaccatcagcacgcctggcagtcccgtagtacgttacgttttacgaccttaaacttacctaacgtcggggacctaacggtctaacctaaattaaactaacgttaccgttaacggttttaccggggaacggggtaacggggaacccgtaaagggggtaacgggaaacgttaacgttaaaccgaaaaccgggtaacgttcgggttacgggttccttacgggaaccactaacgttcgttacggttacctttaacccgttaacgtttaacccccg

SEQ ID NO: 400625 - DNA, 647 bp, Homo sapiens
  misc_feature: GZ8MTXP01B2O61.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagtagtattactaaatggttggcctggttcagcagaaaccgagggaaacgaccccaaaagtcctagatctctcgccgtcctcttacttttgacgtaaacggtcgggggtacccctagtacgtaaaggttcaacggcccggtcgaggtggactcgtaagggaacaagtaattcagtctcacatcagcaggcctgacagcctagtaccgtatttcgacctaacttacgtacgtacggtccctaaagttcgacctaaattaaacttaacgttacgtaagtttccgggacggggtaacgggaacccgtaaggggttaaggaacgaagttaccgaaaaccggtaaagttcgggacggggttcttaccggaactaaccccgtaagtttcccttgggttaccctttaaccggttaacttttcccccggg

SEQ ID NO: 400626 - DNA, 545 bp, Homo sapiens
  misc_feature: GZ8MTXP01AUCK6.15.28.C06.1.454.CMB.2.raw
  modified_base (348)..(348): a, c, t, g, unknown or other
  modified_base (521)..(521): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtatactaaatggttgctgttcagcagaacaggaaacacccaaagtcctagatctctcgccgtcctctacttgacgaagtcgggtaccatcgaaggtcacgcgcagtgatcgtagggacngaagtcagtctacacatacagcagcctgacagtcctagtacgtatttgactaacgttactactggacctaagtcactaaataacgtatacgtagttacgggtacggaacggtaccgtaagggtaacgaaggttaactacgaaacgtaacgtggttacggcttacgaactactnttcgtcttctaacttcgttccccg

SEQ ID NO: 400627 - DNA, 581 bp, Homo sapiens
  misc_feature: GZ8MTXP01DDTNL.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatgacccagtctccgtccacctgtctgcatctgtcggagacagagtcaccatcacttcggccgggcagtcagagtattactaaagtggttggctggttcagcaagaacgagggaaacgacccaaagtcctgatctctcgccgccttacttacgtttcgactaaacggttcgggggtacccagtacgtaaggttcacggcggcgtagtcggatcgtaagggacaaggtaacttcgaacgtctaccactatacagcagcctgcacgcctgacgttatttgactaacttactcgagtacaaggtcactaataaatagtcttagttcgggacggtaggaaccgaagggtaaggtaagactaacgaaacgtacgtaggttcggcttcgaacctaacctaagttcctagttaccttcttaacgtttcccg

SEQ ID NO: 400628 - DNA, 561 bp, Homo sapiens
  misc_feature: GZ8MTXP01BICFQ.15.28.C06.1.454.CMB.2.raw
  modified_base (351)..(351): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaacaggaaagcccaaaagtcctgatctctgccgcctctactttgcaaagtggggtccatcaaggttcagcggcagtggatcgtagggacngaattcagtctcacatcagcagcctgcagcctgacgtattttgactaaacttactaacttcggacctaaagttcgactaattaaataattaccgtaagttttaccggggacgggtaaacggggacccgaaaggggttggaaagttaagtaacgaaacgtaacgtgttacgggcttggaacacctaatcctgttacttcgaactttccccg

SEQ ID NO: 400629 - DNA, 818 bp, Homo sapiens
  misc_feature: GZ8MTXP01CCTG8.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagacgtcacatcacgttcgccggcagtcagtagtatactaagtggtgctgttcagcagaacgaggaaacacccaaagtcctgatctctcgccgtccttctacgtttcgacgtaaacgggttcgggggtacccctagttacgtaacggttcgacggcccggacgtaggtacgggtacgttccggtaagggggaacctaaggtaaactttccgtaaacggtttcccttaacccaacccgtacttacccgaaacgtcccgaaccggtcccgttggacccgtaaccgggttaccccgttacgggttaaacccgggttttaacttttttacccgggaaccccttttaaaaccccttttaacgttaaaccccgtttacgggggaaaccccgttaaagggtttaccggaacccgtttaaaattaaaacctttaaacgttaccgtttaaacggggttttacccgggggaccgggggttaaacggggtaaccccgggtaaagggggtgggtaaacgttaacggttaaaccgaaaacgggtaaacggttcgggttacggttaccgttcggaacccgtacctaacggtttcctcggtttacccgtttaaccgttaacccttttcccccgg

SEQ ID NO: 400630 - DNA, 730 bp, Homo sapiens
  misc_feature: GZ8MTXP01DLZ10.15.28.C06.1.454.CMB.2.raw
  modified_base (198)..(198): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagagtcacatcacttgccggcagtcagtagtattactaaagtggttgcctggttcagcaagaaccgaggaaacacccgaaaagtcctagatctctcgcccgccttacttactttcgacgtaaacgggttcggggtccagttccggaggttcgacggccggcgagtggacgtcgtaagggacaaggtaactacgacgttctaccactacgtcaacgtacacgtccgtagaccgtacggtacccgtaggtaacggtttacttttaccggaacccttaaaccgtttaaacctaacccgttacggggtaaaccccgtaaagggttaaccgtaaaccgttaaatttaaaacttaaacgttaccggttaaacggttttacccgggggaacggggttaaacggggaaacccggtaaaggggttaacgggaaacgttaaacgtaaaccggaaaacggtaccgttgggttaccggttcgttaccgtaaccaacccgttaatttcccgtagttacccttccgttaacgttttaacccccg

SEQ ID NO: 400631 - DNA, 671 bp, Homo sapiens
  misc_feature: GZ8MTXP01ARPJ1.15.28.C06.1.454.CMB.2.raw
  modified_base (434)..(434): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatcgacccagtcctccgtccaccctgtctgcatctgtcggagacagatcaccatcacgttcgccggcagtcagtatattactaagtggtgcttgttcagcaagaacgaggaaacgacccaaagtcctagactctactcgccgtaccttcttacgttagacctaaagggttcggggtaccccagttacgtaaggttacgacggccggtacagggtacggtaacgtcggtaagggaacctaaggtaactttacgagtttcccacacctataccggacncgacgcctcgacgacgtaccgtagtacgttactttacgaacttaacttacgtaacgtacggacgtaagtactaacttaaattaacgttacgttacgttaacgggttacggggtaacgggtaacgggaaccggtaaggggtaacggaacggttaacgtaaaccggttaaacggtacggttggttcggttcttaccgaacctacgtcgttacgttcttaccttaacgttcccgttcccg

SEQ ID NO: 400632 - DNA, 615 bp, Homo sapiens
  misc_feature: GZ8MTXP01BWZ0V.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccggcagtcagtagtattactaatggtgctgttcagcagaacgaggaaacacccaaagtcctagatctctcgccgtcctacttacgttgacgtaaacggtcgggtaccagtacgtaaggttcgaggccggacgaggtggatcgtaagggactaaggtaattcgagtctaccactatacagcagcctagccacgccgtagtacgttatttacgacctaacttactacgtacggactaaaggtctaactaagtaaatacttacgttaacgttcggggaaccgggtaacgggtaaaccggtaagggtaacggaaacgttaaacgtaaaccgaaacgtaaccgtggttacggcttacggaaccctactcgttacgttcgttaccttccttaaccgttccccg

SEQ ID NO: 400633 - DNA, 642 bp, Homo sapiens
  misc_feature: GZ8MTXP01AI6SD.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaaccatcacttcggcccgggccagtcagagtaattactaaagtggtgcctggttcagcaagaaaccgagggaaacacccaaaagtcctagatctctcgcccgccttcttaactttgacgtaaacgggttcggggtacccagtacgtaaaggttcacggccggctaggtggactcggtaacggggaactaaggtaatcgagttacctcaactatccagcaacggtccctgaccgtagcccgttagtaaccgttattttacgacctaaactttacctactacgggacctaagttcgaactaataaatagtaccgttaagtttcgggacggtaacgggaaccgtaaggggtaacgaggttaataacgttaaacgtaacggtgttacggggcttacggaacctactaacgttcgttcgttcctttcgttaacgtttccccg

SEQ ID NO: 400634 - DNA, 648 bp, Homo sapiens
  misc_feature: GZ8MTXP01AMR1Y.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttcggccgggccagtcagtagttattaactaagtggttcggctggttcagacaagaaaccgaggaaacgacccaaaagtcctagctctctcgccgtcctcttacttgactaaaggtcgggtccattacaggttcgacggccggcaggtggatcgtaagggacaagtaacttcagtcctacacctagtcagcacgccgtgcgacgtcctacgtacgtagtttacgacttaacgttactacgtacggacccgtaaaggttcgaactaaacttaaactaacgttacgttaaccggtttcgggggaacgggtaaccggggaaaccgtaagggggtaacgtaacggaaacgtaaccgaaaacggtacgttaacggttcggttcgttacggaaccctactaacgttcgttacgttaccttaacttcccgtttaacccccg

SEQ ID NO: 400635 - DNA, 609 bp, Homo sapiens
  misc_feature: GZ8MTXP01BLGAX.15.28.C06.1.454.CMB.2.raw
  modified_base (251)..(251): a, c, t, g, unknown or other
  modified_base (253)..(254): a, c, t, g, unknown or other
  modified_base (277)..(277): a, c, t, g, unknown or other
  modified_base (283)..(283): a, c, t, g, unknown or other
  modified_base (403)..(403): a, c, t, g, unknown or other
tcagtctacgtagccacgaccggtgctcgatttagagctcacgtattgggtttggggggagtcagactcagtcaggacacagcatggacatggagggtccccgctcagctcctggggctcctgctgctctggctcccaggtgccaaatgtgacatccagatgacccagtcctccgtccaccctgtctgcatctgtcggagacagagtcacatcacttggccggcagtcagatattactaatggtgctgttnannagaacaggaacacccaaagtctnatctcncgccgctactactttgacgtaaaggtcggggtaccagtacgtaaggttcgacggccggactaggtggtatcgtagggaactaagtaacttcacgtctaccgacaatcgagcacgtcccgngaccgtacgtaccgtagtacgttacttacgacttaacttactacgtacggtaacgtagtactactaaataacgtaacgtacgttacggttaccggggacgggtaacgggtaacgtaagggtaacggaacgttaacgtaaacgaaacgtagtcggttacggttcttacgaactaccttaagtcgttcttacctaacgttccgttccc

SEQ ID NO: 400636 - DNA, 641 bp, Homo sapiens
  misc_feature: GZ8MTXP01ET7GU.15.28.C06.1.454.CMB.2.raw
  modified_base (381)..(381): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccggcagtcagtagtattaactaaatggttggcctggttcagcaagaaccagggaaacgacccaaaagtcctagatctctcgccgccttcttactttgacgtaaacggtcggggtaccccagtacgtaaggttcaggtcccggcaggtgatcgtaagggaacngtaaattcagtactacactatacacgtcacgcctagccacgtacccgttaggtaaccttagttttacgacccttaaacctttaccgtacctacggggaaccctaaagggtctaccttaaataaacttaactccgttaaggtttccgggaacgggtaacgggaacccgtaagggtaacgaacgaactaacgaaaacgtaacgtggttacggttcttcgaaccctactaacgttctcggttccttaacgttaacgttccccg

SEQ ID NO: 400637 - DNA, 617 bp, Homo sapiens
  misc_feature: GZ8MTXP01AXPG3.15.28.C06.1.454.CMB.2.raw
  modified_base (342)..(342): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaatggtgctggtcagcagaacaggaacacccaaagtcctagatctactcgccgtcctcttacttgactaaaggtcggggtacccagttcgaaggttcacggcccggnaggtcgtatcgtaagggacaagtaactcagtcctacaccatccaagcgacgtccgtcgcgacgtaccgtagtacgttactttacgacttaaccttactacgtacggaacgtaagtacgtaactaaacttaacgttaacttacggtaacggttacggggaacgggtaacgggtaacgaagggtaacggaacgttaaacgtaaacgttaaacggtacgttcggttcggcttacgaaccgtacgtaacttcgttcgttaccttcgttaaccgttcccg

SEQ ID NO: 400638 - DNA, 716 bp, Homo sapiens
  misc_feature: GZ8MTXP01DN6FO.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctcccgtccaccctgtctgcatcgtggtcggagacagacgtcacatcacgtcggccggcagtcagagtaattactaagtggtgctgttcagacaagaaacgaggaaacacccaaagtcctagactctctcgccgtccttacgttacgtttacggacgtaaacgggttccggggtaccctaagtacgtaaacggttccgacggtcccggacgtagggtcggacgttacggtaaacgggaaacctaaggtaaactttccgtaaacgttacctaccgaacctagtacaacggtcaacggccctaggaccacggtacccgtagtacgttacgtttacgaacttaaaccttactaacgtacggtaacctaaaggttcaacctaaattaaactaacgttcggttaaacggtttccgggaaacggggtaccgggaaaccggttaagggtaacggaacgttaacgtaaacgaaaacggtacgttgggttacgttccgttacggaacctaaccgttaacgttccgttacgttaaccttccttaaccgtttcccccg

SEQ ID NO: 400639 - DNA, 596 bp, Homo sapiens
  misc_feature: GZ8MTXP01A9HLH.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaaatggtgcctggttcagcaagaaaccagggaaacgaccccaaaagtcctagactctctcgccgtcctctactttgacgaaaggttcggggtcccagtcgaaggttcaggccggcaggtggatcgtaaggggacaaggtaaacttcgagttcaccaaccatcaacgcaagccctgaccagccctagacttattttacgacctaacttactactcggaccaagtcaactaataaacgtatcgtagtttaccggggagggaacgggaacctaaggggtaacgaagttaactaaccgaaaacggtaacgttgggcggcttacggccctaaactcgttctcgttccttccgaaccgtttccccg

SEQ ID NO: 400640 - DNA, 649 bp, Homo sapiens
  misc_feature: GZ8MTXP01DWTAK.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagagtattactaaagtggtgctggttcagcagaaacgaggaaacgacccaaaagtcctagactctctgccgccttactactttgactaaaggttcgggggtacctagtcgtaaaggttcaacggcccggacgtaggtggactcggtaaggggaactaaggtaaactttcgagttacctaccaacctatcgaagtccaggtccctacgacgacgtacgtacgtacgttacgttacgtactaacttactactacggtacgtaagtacgtaactaataaattaacgttacgttaacggttacgggtacgggtaacgggtaacggtaagggtaagggtaaacgttaacgtaaacgttaaacggtaaacgtacggttacggttcgttacgtaacctacgtaacgttcgttcgttacttccgttcgttccg

SEQ ID NO: 400641 - DNA, 599 bp, Homo sapiens
  misc_feature: GZ8MTXP01CDN5X.15.28.C06.1.454.CMB.2.raw
  modified_base (392)..(392): a, c, t, g, unknown or other
  modified_base (557)..(557): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttgccggcagtcagagtattactaagtggtggctgttcagcagaacaggaaacacccaaagtcctgatctctcgcccgccttctactttcgacgtaaacgggtcggggtaccccagtactaaacggttcaacggcccggacgaggtgggtactcgtaaggggacaagtacttcagtcncgaccatcagcacgcctgcacgtccgtagtacgttatttacgaccttaacttacgtactcggggacctaagtcgaactaattaaagtactacgtacgtttcgggaccgggaagggaccgaagggtcgggaattaacgtaaacgaaacggtaacgtggttacggcncggtaaccactaattcgtcgttacctccgttaactttccccg

SEQ ID NO: 400642 - DNA, 746 bp, Homo sapiens
  misc_feature: GZ8MTXP01CPVON.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcactcggccggcagtcagagtattactaatggttggctggttcagcaagaaacgaggaaacgacccaaaagtcctagatctctcgcccgtcctcttacgtttgacgtaaacggtcggggtaccagttacgaaggttcgaggtcccggacgtaggtggaacttcggtaagggaactaaggtaaactttccgaacggttctaccaacctataccgaacgtcaacgtccgtacggccgtaacggtccgttagggtaaccgttaagtttttcggaaaccttaaacctttaaccggttaaccttacgggggtaacccttaaagggttacgtaacctaaagtttaaaacttaacgttaacgtttaaaccgggtttccggggaaaccgggggtaaggggtaacccggtaaaggggaagggtaaacggttaacgttaaaccggaaaaccggttaaaccggtgggttacggggccttaaccgggaaccctaaacccgttaacttcccgtttacggttacctttaaccgttaacccttttcccccgg

SEQ ID NO: 400643 - DNA, 596 bp, Homo sapiens
  misc_feature: GZ8MTXP01D03HR.15.28.C06.1.454.CMB.2.raw
  modified_base (202)..(202): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctggtcgganacaggatcaccatcacgttcgccggcagtcagtatatactaaatggtgctgttcagcaagaacaggaaacacccaaagtcctagatctctcgcctcctacttacttcgactaaggtcggtacctatacgaggttcaggccggacaggtggatcggtaagggaacaaggtaacttcacgtacctacacagttacacgacacggtctcggacctacgtaccgtcggtaaacttacgtttacgacttaaaccttactaacgtcggaaccgtaagtaccaataacttaaatatacgtagttacggcgggaaggacgaagggtaacgaattaagaacgaaaacgtgtgacggttcacgtaaccgtaactcttacgtcttaacttccttaacgtttcccc

SEQ ID NO: 400644 - DNA, 588 bp, Homo sapiens
  misc_feature: GZ8MTXP01BB9Y5.15.28.C06.1.454.CMB.2.raw
  modified_base (198)..(198): a, c, t, g, unknown or other
  modified_base (248)..(248): a, c, t, g, unknown or other
  modified_base (251)..(251): a, c, t, g, unknown or other
  modified_base (272)..(272): a, c, t, g, unknown or other
  modified_base (276)..(276): a, c, t, g, unknown or other
  modified_base (278)..(278): a, c, t, g, unknown or other
  modified_base (328)..(328): a, c, t, g, unknown or other
  modified_base (345)..(345): a, c, t, g, unknown or other
  modified_base (378)..(378): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtcctgcatctgtcgganacagagtcaccatcacttgccggcagtcagatatactaagtggtgctgtnagnagaacaggaacaccaaagtcnatcncncgccgctctactttcgactaaggtcggtccagtacgaaggttcaggccgntagtgatcgtagggacngtaactcagtctacaccgatcagcgacgtccgngacctacgtaccgtagtacgtttacttacgaccttaacttacgtacgtacggtaacgtaagtacaactaaagtaaacgttacgttacggttacgggttaccggggaacggggtaacggtaacggtaagggtaacgtaagttaaacgtaaacgaaacggtacgtggacgttcttacgaacctactcgttcgtcttaccttcttccgtcccg

SEQ ID NO: 400645 - DNA, 605 bp, Homo sapiens
  misc_feature: GZ8MTXP01ED4S0.15.28.C06.1.454.CMB.2.raw
  modified_base (413)..(413): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtcaccatcacttgccggccagtcagtagtattactaaatggtgctggttcagcaagaaacgaggaaacacccaaaagtcctagatctactcgccgccttacttactttgactaaacggtcggggtacctagttacgaaggttcaaggccggactaggtcggaatcgtaagggaactaagaattacagtctacaacatcagacagtccgngcaagtccgtaggtactactttacgactaactttactacgtggaacccgtaagtacactaaattaataattcgtaagttcgggaccgggtaaggaaccgtaagggtaaggtaagacttaacgaaaacggtaacgtggttacgggcttaggaaccaaccttcgttccgtcttaccgttaaccttccgttcccg

SEQ ID NO: 400646 - DNA, 680 bp, Homo sapiens
  misc_feature: GZ8MTXP01EFEEE.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccggcagtcagatattactaaatggttgctggttcagcagaaacaggaaacaccccaaaagtcctagatctctcgccgcctcttactttgacaaaggttcggggtaccagttacaaggttcaggccggacgaggttggactcgtaggggaactaaggaaatttcgaagttcctaccaacagtaccaggcaacgcctaggcagtaccgtgtaacgttactttttagacccttaaactttacgtaaccgttcgggaacccgtaaaggtttacgaaccaaagtttaaaagttaaactttcccgttaaaagttttccgggggaccgggtaaacgggggaaacccgtaaagggggttaacggaaaggttaaacgttaaacgaaaaacccggtaaacgtcggttaggggttccttacgggaaccctacctaacggtttccgttcgttcccttaaccgttcgtttcccccg

SEQ ID NO: 400647 - DNA, 650 bp, Homo sapiens
  misc_feature: GZ8MTXP01EIF9E.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacaggatcacatcacttgccggcagtcagatattataaagtggtgctgttcagacagaaacaggaaacgacccaaaagtcctagtactctcgtcgccgtctacttactttcgacgtaaaggtcggggtacccagtacgtaaacggttcaaggccggacgtagtgggacttacgtaaggggaactaaggtaaacttcgtacgtctaccaactatacgaacgcgaacggcctacgacgacgtaccgtacgtacgttacgtttacgtacctaacttaacttacgtacggtaaccgtaagtagtactaaataaacttaatacgttacgttacgggtacgggaacgggtaaccggtaagggtaaggtaaggaagtaacgttaaacgtaaacgttagttacggttacgttacggtaactaccgtaactcttacttaccttcgttaaccgtttaaccccg

SEQ ID NO: 400648 - DNA, 536 bp, Homo sapiens
  misc_feature: GZ8MTXP01BKKJU.15.28.C06.1.454.CMB.2.raw
  modified_base (249)..(249): a, c, t, g, unknown or other
  modified_base (251)..(252): a, c, t, g, unknown or other
  modified_base (264)..(264): a, c, t, g, unknown or other
  modified_base (377)..(377): a, c, t, g, unknown or other
  modified_base (506)..(506): a, c, t, g, unknown or other
  modified_base (513)..(513): a, c, t, g, unknown or other
tcagtctacgtagccacgaccggtgctcgatttagagctcacgtattgggtttggggggagtcagactcagtcaggacaaagcatggacatgagggtccccgctcagctcctggggctcctgctgctctggctcccaggtgccaaatgtgacatccagatgacccagtctccgtccacctgtctgcatctggtcggagacagagtcaccatcacttgccgggcagtcagagtatacaatgtgctggttnannagaacaggaaanacccaaagtccagatctctcgccgctctactttgactaaaggtcgggtaccatcgaaggttcaggcgaccaggtgatcgtagggaaacagtaatcaagtctacacatcagcancctgcacgcctagaacgttatttcactaacttactactcgacgtaagtcgaacaattaaataatacgagtttacggggacgagggaacaggtagaaggaattacgaaacagttgaggcttgactaaccnttaactntccttataacgttccttaacccg

SEQ ID NO: 400649 - DNA, 590 bp, Homo sapiens
  misc_feature: GZ8MTXP01A18KQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagtatatactaaatggttgctgttcagcaagaaacaggaaacgaccccaaaagtccctagactctcgtcgcccgtccttcttacgtttcgacgtaaacggtcgggggtaccctagtacgaaggttcaggtccggcgtaggtggatccggtaagggaactaagaattcagttccacacatcagcagcctgcagcctagacgtatttagactaacttactaccgtggacctaagtgaactaattaaactagttcgtacgtttcgggacgggtacgggaccgaagggtggaagttataaccgaaacgtaaacgtgaacggcttacggaacctaccgtcttcctcgttacttcgtttaaccgttccccg

SEQ ID NO: 400650 - DNA, 711 bp, Homo sapiens
  misc_feature: GZ8MTXP01ENB5A.15.28.C06.1.454.CMB.2.raw
  modified_base (199)..(199): a, c, t, g, unknown or other
  modified_base (429)..(429): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccacctgtctgcatctggtcgganacagagtcaccatcactcggccggcagtcagtagttattaactaagtggttcggcttggttcagacaaacgaaaccgaagggaacacccgaaaagtcctagtactctcgtcgcccgtctcttactttaggactaaagggttcgggtacctagtacgaaggttccaaggtcccggcgtaggtaggagtcggaacgggtaacaaggtaaacttcgagttccctctaaacccnctaccgacgacgaccggtccgtacgaccggacgtacccgttacggtaaccgtttacgtttaccgaaaccttaaaccttaccgtacgtaccgggtacgtaacgtaccgtaactaaaacgttaaacgttaacgttaaccggttaccgggttaccgggggaaacgggggtaacgggtaaacgggtaaggggtaacggtaaacgttaaacgtaaacgttaaacgtacgtcggacggttcacgtaacctacgtaacgttcgttaccttaccttaaccttccgtcccg

SEQ ID NO: 400651 - DNA, 630 bp, Homo sapiens
  misc_feature: GZ8MTXP01D4FVT.15.28.C06.1.454.CMB.2.raw
  modified_base (200)..(200): a, c, t, g, unknown or other
  modified_base (211)..(211): a, c, t, g, unknown or other
  modified_base (255)..(255): a, c, t, g, unknown or other
  modified_base (279)..(279): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgcatctggtcgganacagagtcacntcacgttcggccggcagtcagtagtatactaagtggttgctgtnagcagaacgaggaacaccaaatcngatctctcgccgtctctattgacgtaacggtcggtacctagtacgtacgtcgacgccggacgtaggtgagtcggtaagggactaagtactcgacgtcctacgacactacagcacgtcaggcagtcctagtacttatttcgaccttaacttactacgtcgaacgtaagtaccataaagttaacttagtacgttacggttccgggacgggtaacgggtaaccgtaaaggggtaacggaacgttaacgtaaaccgttaaaacggtaccgttagggttacggttaccttacgggaacccgttaaccctaagtttacccgtacgtttcccgtttaaccgttaacccgtttcccccg

SEQ ID NO: 400652 - DNA, 577 bp, Homo sapiens
  misc_feature: GZ8MTXP01E0MV8.15.28.C06.1.454.CMB.2.raw
  modified_base (275)..(275): a, c, t, g, unknown or other
  modified_base (389)..(389): a, c, t, g, unknown or other
  modified_base (395)..(396): a, c, t, g, unknown or other
tcagtctacgtagccacgaccggtgctcgatttagagctcacgtattgggtttgggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtattactaaatggttggcctggttcagcagaaaccagggaaacncccaaaagtcctagatctctgcccgcctctactttgacaaaggttcggggtcccatcaaggttcagccggcaggtggatcgtagggacaagtaattcagtctacaccatccgancacgcnncacgcgtacgtacgtacttactactaacttactactacgactaagtacgtactaataataactacgtacgttacgggtacgggacgggaacggaagggtaaggtaagttaacgtaacgaaacgtaacgtaggttcggttcgttacgaactactaacttcttcgttacttccgttcgttccg

SEQ ID NO: 400653 - DNA, 709 bp, Homo sapiens
  misc_feature: GZ8MTXP01DY5OB.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatcgtggtacggagacagagtcacctatcacgttcggccggcagtcagtatattaactaaagtggtgcttgtcagacaagaaccaggaaacgacccaaaagtcctagactctactcgccgtcctacttacgttcggacgtaaacgggttcgggtacccagttacgtaacggtcgaggtccggacgtaggtgacttcggaacgggactaaggtattcagtctaccacgtactcacgacacgtccgtagcgtacgtacgttacgtaacgttttacgtttacgaaacctttaaaccgtttacaccgggtttaacggaacccgttaaaggttaccgaaactttaaaattaaacgttaacgtacggtttaacgggtttacgggggtaacccgggtaagggggtaaacccggttaaggggaaggtaaacgttaaacggttaaacccggaaaaggtccgtgggttaccggttcttaccgaaccttactaacggtttccttcggttaaccttccttaaccgtttccccg

SEQ ID NO: 400654 - DNA, 598 bp, Homo sapiens
  misc_feature: GZ8MTXP01EZK8L.15.28.C06.1.454.CMB.2.raw
  modified_base (172)..(172): a, c, t, g, unknown or other
  modified_base (305)..(305): a, c, t, g, unknown or other
  modified_base (397)..(397): a, c, t, g, unknown or other
  modified_base (583)..(583): a, c, t, g, unknown or other
  modified_base (585)..(586): a, c, t, g, unknown or other
  modified_base (588)..(598): a, c, t, g, unknown or other
tcagtctacgtagccacgaccggtgctcgatttagagctcacgtattgggtttgggggggtccctgagactctcctgtgaagcctctggattcaccttgagcacttattggatgacttgggtccgccaggctccagggaagggctggagtgggtggccaccatacaaaaagntggaagtgacacaacctatgtgaactctgtgatgggccgattcaccgtctccagagacgacgccaagaactcactacatctgcaaatgaacaacctgagagccgaggacacggctgtgtattactgtgtgagngatgtctgcggttgggggcccaggggtaccctggcaccggtctcctcacgcctaccgacaacgggcccatccggtccctccccgtgggcccnccctgcctacgagcgccaccgtcgagcgaccacgtacggccgggtccccgtggggccttcgggcccgttacgggggtaccgtaaacggggtacccttaacccggtttcccgaccgttaaccggtaggtaaaccgttggggaacggccgggggcgtggggaaccgaaaggggcccggacttaaaggngnngnnnnnnnnnnn

SEQ ID NO: 400655 - DNA, 620 bp, Homo sapiens
  misc_feature: GZ8MTXP01AUM3L.15.28.C06.1.454.CMB.2.raw
  modified_base (409)..(409): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggcagtcagagtatactaagtggttggcctggttcagcagaaaccgagggaaagccccaaaagtcctgatctctcgccgcctctacgtttgactaaaggtcggggtacccagtacgtaacggttcaacggtccggacgtagtgggtatcgtaggggaccaagaattcgagtctcaccatcagcagtccgngcacgtactagtacgttatttacgaccttaacttactacgtacggactaagtctaactaattaaacttacgttacgttacggttacgggacgggaacgggaaccggtaagggtaacggaaagttacgaaacgttaaaccggtacggttggttacggccttacgaacctacgtaacgttccgttacggttaccttaacgttaaccgttcccg

SEQ ID NO: 400656 - DNA, 546 bp, Homo sapiens
  misc_feature: GZ8MTXP01D32RZ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcacttgccggcagtcagatattactaaatggtgctgttcagcagaacaggaaacgcccaaaagtcctgatctctcgccgtcctacttacttgacaaaggtcgggtaccagttacgaaggttcgaggtccgacgtagtggactcgtagggacaaggtattcgagtctcgacagtcagcagcctgccagtcctgacgttatttcgactaacttacacgtcggacctaaggtcactaattaaatagtacgtaagttcgggacggaagggtaccgaagggtcgaagagtaacaaagtacgtgcggacttcgcacctaagttctgttcttcaactttccccg

SEQ ID NO: 400657 - DNA, 657 bp, Homo sapiens
  misc_feature: GZ8MTXP01AMG9N.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacgttcgccggcagtcagtagtattactaagtggtgctgtcagcagaacaggaacacccaaagtcctgactctctcgcccgtcttctactttgacgtaaaggtcgggtaccagtacgtaaggttcgagcccggacgaggtgtacgtcgtaaggggaaccaaggtaaacttcgacgttccactaaccgataccaggacacgccctggacctacgtcccgtagtaacgttacgtttacgaacttaaccttaccgttaccgtacggtaccgtaaagtcctaactaaacttaaacgttaactacggttaacggtttaccggggaccggggtaaacgggtaaacccgtaaggggtaaggtaaagttaaacgtaaacgaaaccggtaacgttacgggcgttcgttacggtaacctacgtaacttcgtcgttaccttcttaaccgttccccg

SEQ ID NO: 400658 - DNA, 766 bp, Homo sapiens
  misc_feature: GZ8MTXP01ALUB8.15.28.C06.1.454.CMB.2.raw
  modified_base (305)..(305): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagagtcaccatcacttcggcccgggcagtcagtagtaattactaagtggttcgctggttcagacaagaaaccgaggaaacacccgaaaagtcctagactctcncgaccgtccttacgtaccttggactaacgggtcgggtaccctagtacgaaggttcgacggcccgtacggtaggtaggtacgtcggtaaacggggaactaacggtaaactttaccggaacttaccctaccgtaacccacttacccgaacgtcaacccggtaccgttacggcctaaccggtccccgttaggtaaccttacggttttaccgaaacccttaaacctttccgttaacctacggggtaccctaaaggttcgaaacctttaaaggtaaacttaacttacccgggttaaaggtttccccggggtaaaggggtaacgggtaaacccgtaaggggggtaacttaaaacggacccggttaaaagaaacccggggtaaacggttgggaaacggtttcgacccgtaaccgttaaacccctttcgtttcccgttaccgtttaccttaacgttccccgtttccccg

SEQ ID NO: 400659 - DNA, 728 bp, Homo sapiens
  misc_feature: GZ8MTXP01AS0HA.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccacctgtctgcatcgtgtcggagacagagtccacatcacgttcggccggcagtacagtatattactaagtggttggccttggttacagacaacgaacgaaggaaccacccgaaagttcctagctcctcgcgccgtactccttacttcgacgtaacggtcggtccagtacgagttcgaggtccgtacgtaggtcgagtcgaaaggtacaacgtagttcacgtcctaccgaacactacgacgacctacggccgttcgacgtaccggtaccgttacgttaacgttaccgttaccgtaaccttaaaccggtttaccgtaaccgacggttaacggtaacggttacgtaacttaaacggttaaccttacggttaccggttaacgggttacccggggaaggggtaaaccgggtaaccggtaagggtaacggtaaacgttaaaccgtaaacgggttaaaccggttaacggttacgggttcgggttaaccttacccggaaccgtttaaccgtcgtttaccgtacccggtttcctttaaacccggtttcccgttaaccccg

SEQ ID NO: 400660 - DNA, 690 bp, Homo sapiens
  misc_feature: GZ8MTXP01BIYHO.15.28.C06.1.454.CMB.2.raw
  modified_base (198)..(198): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatctgtcgganacagagtcaccatcacttcggccggcagtcagtagtattactaaagtggttgccttggttacagcaagaaaccgaggaaacgacccaaagtcctagactcctactcgcccgtccttacttacgtttcggacgtaaacggtcggggtacccagtacgtaagttcgaggtccggcgtaggtggtacgtcgtaacggggactaaggtaattccgaagtcctaccgacatacacgtcacggcctacggcctacggtaccgttagtaacgtttacgtttacgaacccttaaactttacgtaaccgttacggggaaccttaaaggtctaaccttaaaattaaacgtacttacggttacggtttccgggacggggtaaacgggaccgtaaagggtaaggtaaacgttaactaaacgaaacggtaccgttagggttccgttacttaccggaactccgtaaacggttccttacggttaccttcggttaaccctttccccgg

SEQ ID NO: 400661 - DNA, 585 bp, Homo sapiens
  misc_feature: GZ8MTXP01E1LCX.15.28.C06.1.454.CMB.2.raw
  modified_base (306)..(306): a, c, t, g, unknown or other
  modified_base (394)..(394): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaaagtggttggcctggttcagcagaaaccagggaaacgacccaaaagtcctgatctactcgccgcctntactttgctaaaggtcggggtccatcaaggttccagccggcagtggatcgtagggacaagtaattcagtctctacatcagcaggtccngccagcctgtactatttcgactaacttactacttgggaccaaggttcactaataaatatcgtacgttcggacgggaagggtaccgaaggggttcggaagttacgtaaaccgaaacggtaaaccgtgggttcgggcttacggaaccctaccgtaacttccggtcgttacctttccgttaacgtttccccccg

SEQ ID NO: 400662 - DNA, 652 bp, Homo sapiens
  misc_feature: GZ8MTXP01CB83U.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcggagacagagtccaccatcacgttcggccggcagtcagtagtattactaagtggttgctgttacagacaagaacgaaggaacaccgaaatcctagactctctcgcctcctcttacgttagacgtaacgggtcggtacctagtacgtaacggttcgacggcccggtacgtaggtggtacgtcggtaacgggaacgtaaggtaacttcgtaacgttccacctaccactaccacggctacgccgtgaccgacgtcgttagtacgttactttacgacttaaacttacctacgtacgtaaccgtaaggtactactaaataaacttactacgttaacggtcggggtacgggtaacggtaaccggaaggggtaacggaaacgttacgtaaacgaaacggtaacgtgggacgttcgttcgtaaccacttaacttcgttacgttcttaaccgttctttaacccccg

SEQ ID NO: 400663 - DNA, 699 bp, Homo sapiens
  misc_feature: GZ8MTXP01DKHIW.15.28.C06.1.454.CMB.2.raw
tcagtctacgtagccacgaccggtgctcgatttagagctcacgtattgggtttgggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcggccggcagtcagagtattactaaagtggttggctggttcagcaagaacgaggaacacccgaaagtcctgactctctcgccgtcctactacgtttcgacgtaaacgggttcgggggtaccctagttaccgtaaggttcgacggcccggtcgtagggttggaacgttccggttaaagggggaaacctaagggtaaactttaccgtaaacggttccctaaccaacccgtaactcgaacgcctaacggtccctgaccgtacgtaccgtacgttaacgttacttttacgaaccttaaacgttacctacgtacggacctaaaggtcaactaaataaacttaatacgttaacggtttccggggaacgggtaacgggaaccgtaaagggtggaaacgaacttaaaccgaaacggttaacgtggttcggacgttaccgcctaaccgttaagttccttacgttactttaaccgttaacctttaacccccg

SEQ ID NO: 400664 - DNA, 634 bp, Homo sapiens
  misc_feature: GZ8MTXP01AGUUC.15.28.C06.1.454.CMB.2.raw
  modified_base (286)..(286): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagacgtcaccatcacgttcggccggcagtcagtattatactaagtggttggcctggttcagcagaacaggaacacccaaagtcnatctcacgccgctctactttgacgtaaggtcggtccatacgaggttcgacgccggacgaggtacggagtcgaagggaaccaagtactcgacgtcctacgacatacagtccagcctaggctacgaccgtgacgtttactttacgacttaaaccgttactacgtacgggtaacctaaggtactacctaaattaactaacttaccggttaacggtttaccggggaacggggtaacgggtaaacccggtaaggggtaacgaacgttaacgttaaaccggaaacggtaacgtcgggttagcccgttacggaaccctactaacgttcgtcttacttaaccttcgtttaaccccg

SEQ ID NO: 400665 - DNA, 789 bp, Homo sapiens
  misc_feature: GZ8MTXP01DKUVB.15.28.C06.1.454.CMB.2.raw
  modified_base (280)..(280): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcacatcactggccggcagtcagagtattactaaagtggtgctggttcagcagaacagggaaacacccaaaagtccngatctctcgccgtcctcttactttcgacgtaaaggttcggggtacccctagttaccgtaaaggttcgaacggtcccggactaggtcgggtatacggttaaggggaactaaggtaaatttccgaagttcctaccaactacgtaccgaacgccgtaacggtcccctgggacctaacgggtacccttaggggtaaccttacgtttttaccggacctttaaaccgtttaacccttaaccgtttacgggtaaaccccgtaaaaggggttccgtaaaccgttaaatttaaaaccgttaaacttcccggtttaaaacggggtttttccggggaaaccggggggtaaacgggggaaaccccggtaaaggggggtttaaacggaaaggttaaaccgttaaaaccgaaaaaccccgggttaaacggttggggttaaacggggccttacgggaacccctaaaaccgttaacgtttacccgttcgtttacctttaacccgttaaccttttaaccccccggg

SEQ ID NO: 400666 - DNA, 553 bp, Homo sapiens
  misc_feature: GZ8MTXP01CGV0H.15.28.C06.1.454.CMB.2.raw
  modified_base (270)..(270): a, c, t, g, unknown or other
  modified_base (335)..(335): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctccaggtgccaaatgtgacatccagatgacccagtctccgtccaccctgtctgcatctgtcggagacagagtcaccatcacttgccgggcagtcagagtattactaaatggtggctggttcagcagaaaccagggaaacnccccaaaagtcctgatctctgccgcctctactttgcaaagtcgggtccatcaaggttcagccggnagtggatcgtagggacaagaattcagtctacacatcagcagcctgcagcctgacgtatttcgactaaactttactaacctgggaccaaagttcgactaattaaatatacgtaacgtttcgggacgggtaacgggaccaaagggtcggaaagacgttaacaaaacgtaacgtgttagggcttcggaaccacctaatccgtgttaccttcaacgtttccc

SEQ ID NO: 400667 - DNA, 657 bp, Homo sapiens
  misc_feature: GZ8MTXP01AXK5S.15.28.C06.1.454.CMB.2.raw
  modified_base (304)..(304): a, c, t, g, unknown or other
  modified_base (354)..(355): a, c, t, g, unknown or other
  modified_base (372)..(372): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgcttattttagaaggtgtccagtgtgaggtgcaactggtggagtcgtgggggagcctcgtccgaggccggggggtccctgagactctcctgtgaagcctctggattcaccttgagctacttatggatggacttgggtccnccgaggcctccgaggggagggctgggagtgggtgccacataacgaaaagnnggaagtcgacacaactntgagaaactcgtgtgagtcgggacctagttacaccgtctaccagacgacgacgaccaagaactacactacacttctagaacaaatacggaaactaaccgtagaacgacgacccggaaggtaccgaaccggtcttaggtagttaacgttacgttggttaggttaggtaaggttaggtagtttcggtttcggttcggggttccgggggtttaaccggggggccccggtaaaccgggggttaaccccggttcgggttaccccgtaacccgggttcccttaacccccgg

SEQ ID NO: 400668 - DNA, 668 bp, Homo sapiens
  misc_feature: GZ8MTXP01CFUNZ.15.28.C06.1.454.CMB.2.raw
  modified_base (199)..(199): a, c, t, g, unknown or other
  modified_base (251)..(251): a, c, t, g, unknown or other
  modified_base (527)..(527): a, c, t, g, unknown or other
  modified_base (543)..(543): a, c, t, g, unknown or other
  modified_base (588)..(588): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatctgtcgganacagagtcacatcactgccggcagtcagtatataatagtggtcgcgttgtanacgacgaaacgaacggaacggaacccaaccgtaaactctagtactctacgtccgtaccctcttacctttacgttacgaacggttaacgggttcccggtaacctacgttaacgtacgggtcgacgggtccccgaggtaggtgtaccttaggaacggaactaactagtacctacgttccacaactacacgacgtacgacgtacgacgaaccgtcgtacgttaacggttacctttacgttactaacccttaaacgttcttaccgacgtaacgtacgtanaacttaaataaacgtntaacggttacggtccgggaaacgggtaccggtaacgtagggtaanacgttaacgtaaaccgaaggtacgtgggacttcggacctctaaccttcttacgttcttaccttaacgttccctttccccg

SEQ ID NO: 400669 - DNA, 764 bp, Homo sapiens
  misc_feature: GZ8MTXP01CSCJU.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctcccgtccaccctgtctgcatcgtggtcggagacgagacgtaccacctatcctacgtcggccggcagtacagtaattattaactaagttggtcgtcgttggttacacgacgaaacgaaaccgaacgggaaaccgaacccgaaaacgtcccgtagacttccgtcgtaccgtcccgtacccttacgttacgttacggaacgtaaacgggttccgggtaccctaggtaccgtaaacggttcgaacgggtccccggtaaggtaggtacggtacgtcgggtaaaacgggtaacgtaacgttaacttacgtacgttaccaccacctacgaccgacgacgacgaccgtagaccgtacgtaccgttacgttacgtttactttacgaccgttaaaccttacgtaaccgtacgacggtaagttactaactaaattaaacgttacgtaccggttacggtacggggtaaccggggaaggtaaccgggtaaggggtaagtaaacggttaaacggtaaacgaaaccggttagggtacgttcggttacgttaccgtaacctaccggttaacttaccggttcgttacccgttccttaaccggtttccccg

SEQ ID NO: 400670 - DNA, 651 bp, Homo sapiens
  misc_feature: GZ8MTXP01EUFZG.15.28.C06.1.454.CMB.2.raw
  modified_base (386)..(386): a, c, t, g, unknown or other
  modified_base (576)..(576): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagtcttgggtttttccttgttgcttattttagaaggtgtccagtgtgaggtgcaacgtggtggagtcgtgggggaggcctcggtccgagggcccgggggggttccctggagacctctccgtgtgagcctctggattcaccttgacgtctacttatggatggtacgttcgggtcccgcgaggcctccggaggggaaggggcgtggggaggtggggtcggaccaaccaataaacgaaaaagngtaggaaagtgaacccactaactatgtacgaaacttcgtgtgagtcggggacctattaccgaccgtctccgaagacgaccgacgaccaagtaactcaactacgatctagaacaaatacgggaaacctaacgacggaagaccgaccggaaggacccgaacgggtcttagttagttacttaacgtggttagnggaggttagtagtggttacggttcgttcggggttcgggacgtaacgggtaccctgggttacctccggttcctccg

SEQ ID NO: 400671 - DNA, 659 bp, Homo sapiens
  misc_feature: GZ8MTXP01AWWQF.15.28.C06.1.454.CMB.2.raw
  modified_base (199)..(199): a, c, t, g, unknown or other
  modified_base (253)..(253): a, c, t, g, unknown or other
  modified_base (280)..(280): a, c, t, g, unknown or other
  modified_base (360)..(360): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctccgtccaccctgtctgcatctgtcgganacagagtcaccatcacgttcgccggccagtcagtatatactaagtggtgctgtnagcagaacgaggaacaccaaagtctanactctcgtcgcccgtctacttacgttgacgtaacggtcgggtacctagtacgaagttcgaggcccgtacgaggtacggtntacggtaagggaactaagtaacttacgacgtcctactaacctgtactacgaccgtacgtccgtgaccgaacgtccgtaggtaacgttacgtttacgaacgttaaaccttacgtaccgtcgggttaacccgaagttacgtaacctaaagttaactaacgttacgtaacgggtttccggaacgggtaccggggtaaaggtacgggtaacggacgttaaacgtaacccgaaaggtaaacccgttggttacgcgttacgtaaccgactaacgttcgtcttaccgttaagttcccttaaccccg

SEQ ID NO: 400672 - DNA, 658 bp, Homo sapiens
  misc_feature: GZ8MTXP01BUYWY.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccaccctgtctgcatcgtgtcggagacagagtcaccatcacgttcgccggcagtcagtagtatactaagtggttgctgttcagcaagaacgaggaaacacccaaagtcctagactctctcgccgtcctcttacgtttcgacgtaacggttcgggtaccctagtacgtaaggttcacggccggacgtaggtggtactcggtaacgggaactaagtattccgtacgtctaccacctatacgacgccacgcctgaccagtcccgtagtaaccgttatttacgaccttaaaccgttactaccgtcgggtaaccgtaaggtactaactaaattaacttaacgttcgttaacgggttaccgggtaacggggtaacgggaaccggtaaaggggtcggaaacggttaactaaaccggaaacggtaaacgtgggttacggccttcggaaccctacgtaacttcgtcttaccgtttaaccaaccgtttccccg

SEQ ID NO: 400673 - DNA, 606 bp, Homo sapiens
  misc_feature: GZ8MTXP01EWLY8.15.28.C06.1.454.CMB.2.raw
  modified_base (271)..(271): a, c, t, g, unknown or other
  modified_base (310)..(310): a, c, t, g, unknown or other
  modified_base (364)..(364): a, c, t, g, unknown or other
  modified_base (396)..(396): a, c, t, g, unknown or other
  modified_base (478)..(478): a, c, t, g, unknown or other
  modified_base (504)..(504): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgcttattttagaaggtgtccagtgtgaggtgcaacgtggtggagtcgtgggggagcctcgtccgaggccggggggtcctgagactctctgtgaacgcctcgnggattcacttgagctacttatggatgacgttgggtcccncgaggctaccgagggggaagggctgggagtgggcgccaaccataaacaaaaagngtaggaaacgtgaacacaaacctagtagttanaacctgtggtgagtcgggctagttccaccgtctcctcacgccctaccaaccgacgggcccacgttccggtccccttccccgnggcccacccgtgaccctccgaggccnccacccgtcgagccgcaacgcggcccgtcgtaggggccacgttcccgtggaccgaaggttccttccgttcgacttaacggagcgttcggaacgcgggtaacg

SEQ ID NO: 400674 - DNA, 737 bp, Homo sapiens
  misc_feature: GZ8MTXP01BSOPG.15.28.C06.1.454.CMB.2.raw
  modified_base (464)..(464): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctcccgtccaccctgtctgcatcgtggtcggaagacagacgtccaacctatccgtacttcggccggccagtcaagtagttattaacgtaaagttgggttcggtcgttggttcagacgaacgaaaccgaagggaaaccgacccgtaaagtcctagtactccgtacctcggtcccctccttacgttacgtttacggaaccgtaacgggttcggggtaccctacgtacgtaacggtcgaggcccgacgaggtcgacgtcggtaaggaactaaggtaactcgtacgtcctaccaccgtntacacgcctaacgccgtacggccgacgtaccccgtagttacgttacgtttagaacccttaactttacgaccgttcgaacccgtaaggtacctaataaacgttaaacgtaacgttaccgttaagggtttacccggggaacgggtaaccgggtaaacggtagggttaaacgaacgttaacgtaaacgttaaacggtaacgtcggttacggttccttaccggtaactaccccggtttcgttaccgttcgttacccgttaaccgttcccgttccccg

SEQ ID NO: 400675 - DNA, 651 bp, Homo sapiens
  misc_feature: GZ8MTXP01DK3VR.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttggccggcagtcagagtatactaaatggtgctgttcagcaagaacgaggaaacgacccaaagtcctgatctctcgccgcctcttactttgactaaagggtcgggtacccatacgtaaggttcaggccggacaggtggatcgtaaggggaacaaggtaacttcgagtcctacaccatacgacgcacgcccgtgccgacgtacctagtaccgttagttttacgaacttaaacctttactaaccgttcggaacccgtaaaggtacaacttaaattaaacttaacgtacgttaacggtttccggggacggggaaacggggtaaccgaaaggggtaacggaaaggttaactaaacccgaaaaggtaaccgttggttacgggccttacggccctaaaccgtcgtttccttacggtttaccttaaccgttaacctttcccccg

SEQ ID NO: 400676 - DNA, 632 bp, Homo sapiens
  misc_feature: GZ8MTXP01AW73H.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccgggccagtcagagtatactaagtggttggctggttcagcagaacgaggaaacacccaaagtcctagatctctcgcccgtcctacttactttgacgtaaacggtcgggggtaccctagttacgtaaaggttcaggccggtacaggtggactcgtaagggactaagattcagtcctacgacatcacgcacgcctggacacgtccgtagtacgttactttacgacttaaaccttactacctacggggtaccctaaaggttcaactaattaaataacgttacgtaaggtttccgggaaccgggtaagggaacccgtaaggggtaacggtaaacgttacgtaacgaaacggtacgtaggttcggttcgttacgaaccgtacctaagttcctcggttaccttcgttaacctttccccg

SEQ ID NO: 400677 - DNA, 616 bp, Homo sapiens
  misc_feature: GZ8MTXP01BF0FB.15.28.C06.1.454.CMB.2.raw
  modified_base (427)..(427): a, c, t, g, unknown or other
  modified_base (598)..(598): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgaccagtcctccgtccaccctgtctgcatctgtcggagacagacgtcaccatcacttcggccggcagtcagtatattactaagtggtgctgttcagacaagaaacgaggaaacacccaaagtcctagactcgtcgtcgccgtcccttactactttggacgtaaagggtcggggtacctagtacgtaaggttcaggcccggacgtaggtggacttcggtaagggaacaaggtaactcgacgtctaccaccatccagcgacgtcccgngaccgtacgtaccgttagtacgtttagttaccaaccttaacgttaacgtacgacggtaactaagtactaacgtaaattaacgtacgtacgttacgggtacgggaacgggtaacggtaacggaagggtaagaacgttaacgtaaacgaacgtacgtgacgcgactaacactntctcttctcgttcgtccg

SEQ ID NO: 400678 - DNA, 741 bp, Homo sapiens
  misc_feature: GZ8MTXP01APUCW.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtctccgtccaccctgtctgcatcgtgtcggagacagagtcacatcactggccggcagtcagagtatactaagtggttgctgtcagacagaacaggaacaccaaagtcctagactctctcgccgtcctctacttcgactaaggtcgggtccagtacgaaggttcgaggccggacgtaggtggactcggtaacgggaactaaggtaacttcgtacgtccgtaccaacaactcgaaggccctaacggcccgtacgggacctacggtaccccgttaggtaaccgtttagttttaaccggaacccttaaactttaccgttaaccgttaccgggtaacccgtaaagggtttaaccgaactttaaacgtttaaaacgttaactttaccggtttaaacgggttttaccgggggaaccgggggtttaaaacggggaaacccggttaaagggggaaggtaaacggttaaacgttaaccggaaaaaaccggttccggttgggttaaccggggttcttacggaacccgttaccttaacggtttacccgttacgtttacccgttaaccttaaccccggtttcccccg

SEQ ID NO: 400679 - DNA, 625 bp, Homo sapiens
  misc_feature: GZ8MTXP01EVGET.15.28.C06.1.454.CMB.2.raw
  modified_base (256)..(256): a, c, t, g, unknown or other
tcagtctacgtagccacgaccggtgctcgatttagagctcacgtattgggtttggggggagtcagactcagtcaggacacagcatggacatgacgggtccccgctcagctcctggggctcctgctgctctggctcccaggtgccaaatgtgacatccagatgacccagtctcccgtccaccctgtctgcatcgtgtcggagacagagtcaccatcacgttgccggcagtcagagtatactaagtggtgctgttacngcagaacaggaaacgcccaaagtcctgatctcgtcgccgcctcttactttgacgaaacggtcggggtcccatcgaaggttcaggtccggcgtaggtggagtcgtaggggacaaggattcagtctacacatcagcagcctgacacggtccctggtacttagtttcacttaaacttactacgtggacctaagtgactaaagttaaactaacgtccgttaagtttccggggacgggtaaacggggtacccggaaaggggttgggaaagttaaacgtaaaccgttaaaacggtaaaccgttgggttacgggttccgttacggaaccctaacgtaacgttccttaggttcccttttaacgttaacctttccccg

SEQ ID NO: 400680 - DNA, 809 bp, Homo sapiens
  misc_feature: GZ8MTXP01A6J82.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctcccgtccaccctgtctgctatcgtggtcggagacaggacgtccaccatcacgttcggcccgggcagtcgaagtagttaattaacgtaaagtggttcggtcgttggttacagacgaaacggaaaccgaacgggaaacgacccgtaaaacgtcctagtactcctcgtcgtcccgtccttacgttacgttacgacgtaaacgggttcggtaccctagtacgtaaggttcgacggccggtacgtaggtacggtacgtcggtaacggggaactaagtacgttacgtacgttaccctaccgtacctacgtccaacgccgaccgtccgtacgaccgtacggtaccgtaacggttacgttacgtttaccgtaaccttaactttaacgtaccgtacggggtaaccgtaaggtactaaccttaaattaaacgttacgttaacggttaaacgggtttaccgggggaacggggtaaaccggggtaaacggttaaacgggggtaacgggtaaacggttaaccggtaaaaccgggttaaaaccggttacgggttacgggttaaccgggttccgttaccgggtaaccctaaacccgggtttaacttcccgtttaacccggtttccctttaacccgttaaccggttttcccccg

SEQ ID NO: 400681 - DNA, 690 bp, Homo sapiens
  misc_feature: GZ8MTXP01BKZHU.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctggtcggagacagagtcacctatcacgttcggccggccagtcagtagttattactaagtggttgccttggttacagcaagaaccgagggaaacacccaaagtcctgactcctcgtcgccgtcctctacgtttgacgtaaaggtcggggtacccatacgaacggttcaggccgcaggtggtactcggtaagggacaaggtacttcgacgttcctacaacctataccgacgccgaacgtccccggtacgaccgtacgtaccgttacggttacgtttaacgtttaccgtaaccttaaacgttacgtaaccgtacggtaacgtaacgtacgtaaacttaaattaaacgttacgttacggttacgggttaccggggaacggggtaacggtaaacggtaagggtaacggtaacgttaaacgtaaaccgttaaacgtacggtcggttacggttcgttaccgaacctacgtaacgttccgttacgttaccttccgttaaccgttcccg

SEQ ID NO: 400682 - DNA, 765 bp, Homo sapiens
  misc_feature: GZ8MTXP01EUCTB.15.28.C06.1.454.CMB.2.raw
  modified_base (283)..(283): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctccaggtgccaaatgtgacatccagatcgacccagtcctcccgtccaccctgtctgcatctgtcggagacagactcaccatcacttcgccggcagtcagagtattactaagtggtcgctggttcagacagaacgaggaacaccgaaagtcngactctctcgccgtctcttacttagacgtaacggtcgggtaccagttacgacggttcgaggccggacgtaggtaggtactcggtaacgggaactaagtaacttcgacgtacctaccacgactaccacgaccgtacgacccgtggaccacggttaccccgtaggttaaacgtttaacgttttacggaaaccccgtttaaactttaacccgttaaccgtaccggggtaacccgtaaaggggttacgtaacccttaaaaggtttaaaccctttaagtttaccggttaaacggggttttacccgggggtaaaccggggaaacggggggtaaaccgttaaagggggtaacggtaaagttaaaccgggtaaacccgttaaaacgggtaaccggttaaggttccggttaccggttacgaaccccgttaaccctaacggttttccccgttaacgtttcccgtttaaccccgtttccgtttaaccccccgg

SEQ ID NO: 400683 - DNA, 596 bp, Homo sapiens
  misc_feature: GZ8MTXP01CZS9H.15.28.C06.1.454.CMB.2.raw
  modified_base (256)..(256): a, c, t, g, unknown or other
  modified_base (278)..(278): a, c, t, g, unknown or other
  modified_base (586)..(586): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctccgtccaccctgtctgcatctggtcggagacagagtcaacatcacgttggccggcagtcagagtatactaagtggtgctgtcaganagaacgaggaacaccaaagtcngatctctcgccgctctacttgacgtaacggtcgggacctatcgtaaggttcgacggccggacgtaggtggactcggaacgggaacaagtaacttcacgtctaccacatcacgtcacgccgtgcagtccgtagtacgttatttacgacttaaacttacacgttcggaccgtaaggtcaactaagttaaactacgttacgttacggttaccggggacgggtaacgggaaccgtaaaggggtaacgaagttaacgtaaccgaaacgtacgtggacgttcttacgcctactaattcttcgttaccttaaccncgtttccccg

SEQ ID NO: 400684 - DNA, 638 bp, Homo sapiens
  misc_feature: GZ8MTXP01AQ1JX.15.28.C06.1.454.CMB.2.raw
  modified_base (310)..(310): a, c, t, g, unknown or other
  modified_base (415)..(415): a, c, t, g, unknown or other
  modified_base (474)..(474): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttggccggccagtcagtagtattactaagtggtggctggttcagcaagaaaccgagggaaacgacccaaaagtcctgatctcgtcgtcccgccttntaacctttgacgtaaaggttcggggtaccccagtcgtaaagggttcacggccggacaggtggactcgtagggaactgaaagtcagtctcacatcgagcgtagccnggcacgtcctaggtacttagtttcaactaaactttcctaacgtcggggaaccttaggtnaaccttaaataaaggttactacgttaacggtttacggggacggggttaaacgggtacctaagggggtaacgaaggttaacaacggaaaaccgtaagggtttcgaagggcttacgggaacctaccgtaacgtttctacggtttctaaccgttaaccgtttccccg

SEQ ID NO: 400685 - DNA, 753 bp, Homo sapiens
  misc_feature: GZ8MTXP01CH9Y7.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccggcagtcagagtatactaaatggtgctggttcagcagaaacaggaaacacccaaaagtcctgatctctcgccgccttctacttttcgacgtaaaaggttcgggggtacccctagtaccgtaaaggtttcaacggtccccgggacgtaaggtgggtaacgttaccggttaagggggaaacctaagggtaaaacttttaccgaaacgggtttacccttaccgaaaccccgtaattacccgaaacggtccaaacggtccccgttaggacccgaacggtccccgttaggtaaccgttagtttttacggaaccttaaaccgtttactaaccgttacgggggaccctaaaagggttcgaaccttaaattaaattaaacttccgttaaacggttttaccgggggaacgggttaaacggggaaccgtaaagggggttaacggaaaggttaaacttaacggaaaacgtaaaccgttggttacgggttcttacggaacaaacccgtttcgttaccgttacgttaccttaaccgttccgtttcccg

SEQ ID NO: 400686 - DNA, 661 bp, Homo sapiens
  misc_feature: GZ8MTXP01ASXYG.15.28.C06.1.454.CMB.2.raw
  modified_base (343)..(343): a, c, t, g, unknown or other
tcagtctacgtagccacgaccggtgctcgatttagagctcacgtattgggtttgggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtggcctggttcagcagaaacaggaaagccccaaaagtcctgatctctgccgcctctactttgctaaaggtggggtaccatcaaaggttcagcccggngagtgatgtagggaactaagtaatcacgtctacactatacgagacacgtcctgacgtacgacctacgtaacgttactttacgacttaaaccgttaacttaccgtacgggtaacccgtaaaggttagaactaaacttaaattaaacgttaacgttacggtttacggggtaaccgggggtaacgggggtaaaccgggtaaacggggtaagggtaaaggttaaacgtaaaccgttaaaaccgtaaacggtaacggttacgggttcggttacgtccgtaccgtaacttcgttcgtttaccttaaccgttaaccgttaacccg

SEQ ID NO: 400687 - DNA, 617 bp, Homo sapiens
  misc_feature: GZ8MTXP01EZ4O8.15.28.C06.1.454.CMB.2.raw
  modified_base (342)..(342): a, c, t, g, unknown or other
  modified_base (359)..(359): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaacgacccaaaagtcctgatctctgccgcctctacttgacaaagtcggggtccatcaaggtcagccggnagtggatcgtagggacngtaattcagtctacaccatcagcaggccctgacagcccgtagtacgtattttgacctaaactttaacgtacttacgggacctaaaggtgtacctaaattaaaactattactaacgttttcggggaccggggtaacggggtaaccggaaaggggttaaggaaacggaaagttaaaccgaaaaccgtaaacgtcgggttagggttccttacgggtccaaacccttaatcccgttggttacctttccgttaactttccccg

SEQ ID NO: 400688 - DNA, 671 bp, Homo sapiens
  misc_feature: GZ8MTXP01DGNMA.15.28.C06.1.454.CMB.2.raw
  modified_base (368)..(368): a, c, t, g, unknown or other
tcagtctacgtagccacgaccggtgctcgatttagagctcacgtattgggtttgggggggaagaggaagactgaaggcctttccacttggtgatcagcactgagcacagaggactcaccatggaattggggctgagctgggttttccttgttgctattttagaaggtgtccagtgtgaggtgcaacgtggtggaggtcgtgggggaggcctcgtccgaggccggggggtccctgagactctctgtgaagcctctggattccaccttgagctacttagttggatgtacgttcgggtcccgccgaggccgtccgagggggaaaggggcgtgggaggtggggtcggacccaaccgaataaacaaaaaaggngtaggaaagtagaacactaaaccgtatgtacgtaacctctaggtgacgtgggaccctattccgaccgtctaccgagaacgacgacgacctaaagactaccactacattcagaccaaagtacaaacaacctggaagacggaccggaaggaccgaacggtcgttaggtagttaacttagtggtagtggacgtagtagttcgttcgttgggtcgggttacgggaccggtacgggaaacccgttggttaaccctcccggttaccctccgtaccgccgttacccgtaacccgaaccggtaaccccggg

SEQ ID NO: 400689 - DNA, 652 bp, Homo sapiens
  misc_feature: GZ8MTXP01CW6B7.15.28.C06.1.454.CMB.2.raw
  modified_base (578)..(578): a, c, t, g, unknown or other
  modified_base (625)..(625): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctcccgtccaccctgtctgcatctgtcggagacagagtcaccatcacgttcggccggccagtcagtagtattactaaagtggtggtctggttcagacaagaaaccgaggaaacgaccctaaaagtcctagatcgtctcgccgccttacttacgtttagacgtaaagggttcggggtaccctagtcgaacggttcacggcccggtacgaggtcggtacgtacggtagggaacctaagtaacgttcgacgttcctaccaacctagtaccgacgtacgaacgtccgtcgacgacggtaccgacgttaacggttattttaccggactaaacctttacgtacctacgggtacccgtaagtccgtaactattaaactacgtactacggttcggacggtacgggaaccgtaagggngtaacgttaactacgaaacgtaacggtgttacggcttacgaactacnttactgttacctcttaacgtttccccg

SEQ ID NO: 400690 - DNA, 676 bp, Homo sapiens
  misc_feature: GZ8MTXP01AEP4T.15.28.C06.1.454.CMB.2.raw
  modified_base (303)..(303): a, c, t, g, unknown or other
  modified_base (364)..(364): a, c, t, g, unknown or other
  modified_base (413)..(413): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctgtcggagacagagtcaccatcacgttcggccgggccagtcagtagtattactaaatggttggcctggttcagcaagaaccgaaggaaacgacccaaagtcctagatctcncgccgccttctactttcgacgtaaaggtcggggtacccagtacgaaggttcaggtcccggngaggtgacgtcgtaacggggaacaagtaaacttcaggtcctacgaactntacagcacgcctggaccacgtccgtacgtaacgttattttacggaccttaaaccgttacgtaccgttacggaccctaaaggttacaaccgtaaacttaaaacttaaacgtaccgttaaacgggttttaccgggggaacggggtaacggggtaaacccggtaaaggggttaacggaaagttaaacggttaaccgaaaacggtacgtgggttacgccgttagaaccaccgtaacttcgtctttacctaaccgttcttaaccccgg

SEQ ID NO: 400691 - DNA, 832 bp, Homo sapiens
  misc_feature: GZ8MTXP01EALX2.15.28.C06.1.454.CMB.2.raw
  modified_base (201)..(201): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtcctcccgtccacccttgtctgcatctggtcgganacgagagtcaccactctacgttcggcccggactagtacgagtagttattaactaagttggtcgcgttgttacagacgaacgaaaccgaagggaaccaacccgaaagttcctagactcctcgtccgaccgtcctctttacgttcggaacgtaaacgggtccgggtacctagtacgtaacggttcgacggtccggacgtaggtaggtacgttcggtaaacgggtaaccgtaagttaaaccttccgtaaacgtttcccctcaaaaaccccgttcttaacgaccgtacgaaccgtcccgttcgacgacgtacccgttacgggaaccttaagttttttcggaacccttaaactttaaccctaacgtttaccgggaccccgttaaaaggttcgaacccttaaacttaaaagtttaaaccgtttacggttaaaccgggtttttaccgggggtaaaccgggggtaaacgggggaaaacccccggttaaagggggtttaaggggaaaacggttaaacgtaaacccggttaaaaaccgggtaaaccgtttaacgggttacgggttaccgttacgggtaaccccgtaccgttaaccttaccgttacggttttcccgttaacccgttaacgttttccccccgg

SEQ ID NO: 400692 - DNA, 671 bp, Homo sapiens
  misc_feature: GZ8MTXP01ASUP8.15.28.C06.1.454.CMB.2.raw
  modified_base (266)..(266): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagcttgggttttccttgttgcttattttagaaggtgtccagtgtgaggtgcaacgtggtggagtcgtgggggagcctcgtccgaggcccggggggtcctgagactctcctgtgacgcctntggtattcaccttgacgctacttagtggattggtacgttcggggtcccgaccgaggtccgtaccggaagggggaacgggggtcgtagggggagggttcgggggtacggacccaacccaagtaaaacgaaaaaaggtgtaagggaaagtacgaaacccaaccgtaaactagtcggtacgtaaacttcgtgtagacggtcgggaccgtacttaccgaccgttcaccgagacgacgacacaagaacctcactacatctacgaacaaagtcgaaaccacgtagagaccgacggacgtacgcgggtcttggtattacgttgtggtgttaggacgttagtacgtttcgttcgttcgggttcgggtcggggacccgtaacgggtaccctggttccctaaccgttccgtcccc

SEQ ID NO: 400693 - DNA, 819 bp, Homo sapiens
  misc_feature: GZ8MTXP01EVNAM.15.28.C06.1.454.CMB.2.raw
  modified_base (204)..(204): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgaccaaatgtgacatccagatcgacccagtcctcccgtccaccctgtctgctatcgtggtcgganacagactcaccatcacgtcggccggcagtcagtagttattaactaagtggtcgtcgttgttacagacaagaaaccgaaggaaaccaccctaaagtcctagtactctcgtcgcccgtccttacttacgttacggaacgtaacgggttcgggtacccaagttacgtaacggttcgaacggccggtacgtagggtacggtaacgttacggtaaacgggggaactaaggttaaacttaccgtaaccggttaccccgttaacccaaaccccgtaagttacccgaaacggtacccgaaacggtccccgttacggacccgtacggttaccccgttaagggttaaccggtttaacttttaacggaaaccctttaaaaccgtttaccttaaccgtacggggtaaacgttaaacggttaaccgtaaaccttaaaagtttaaaccttaacgtttaccggttaaacgggggtttaccggggaaacgggggtaaccgggtaacgggttaaagggggaaccgtaaagggttaacttaaaccgggaaacgttaccggtagggttccgttaacggttcgaaccctaacccggtttcgttacgttccgttacctttccgttaacccgtcccg

SEQ ID NO: 400694 - DNA, 633 bp, Homo sapiens
  misc_feature: GZ8MTXP01CTDWA.15.28.C06.1.454.CMB.2.raw
  modified_base (589)..(589): a, c, t, g, unknown or other
  modified_base (597)..(597): a, c, t, g, unknown or other
  modified_base (611)..(611): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatcgacccagtcctcccgtccaccctgtctgcatctggtcggagacagacgtccacctactcacgtcggccggcagtcagtatattactaagtggtgctgttcagcaagaacgaggaacacccaaagtctagactctctcgccgtctactacgttacgacgtaaaggtccgggtacctagtacgtaacggttcgacggtccggacgtaggtcggtacgtcggtaacggggaactaagtaacttcgacgtacctaccaactactcgagtccaacgtccgtaggacgaccgtaccgttagtacgttactttacgaaccttaacgttacgtaccgtacggtaacccgtaagttcaaacgtaattaagttaactggtaacggttcgggacgggtaacggacgaagggtaagaaacgttacgaacgaaacgtaacgnggttacgnttacgaactacgtnttcgtcttctaacttcgttccc

SEQ ID NO: 400695 - DNA, 693 bp, Homo sapiens
  misc_feature: GZ8MTXP01ER2P5.15.28.C06.1.454.CMB.2.raw
  modified_base (404)..(404): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagagtcacatcacttggccggccagtcagtagtattaactaaatggtgcctggttcagacaagaaaccgagggaaacgacccaaaagtcctagatctctcgccgcctcttacgtttgacgtaaagggtcgggtacccattacgaaggttcgacgtccggcgtaggtggtagtcgtaaggggaactaagtaacttcgagtccncaaccatacgacgcacggtcctgccagtacccgtaggtaacgttagtttacgaccttaaacctttactaccgttacggggacctaaagggttaactaacttaaattaaacgttaacgttacggttaacgggtttaccgggggaacggggtaaaccgggtaaacggtaaaggggtaaggtaaacgttaaaccgtaaaccggttaaacgtaacggttgttaccgggttacgttaccgaaccctaacgttaacgtttacgttcgtttaccttaaccgttcccgttaaccccg

SEQ ID NO: 400696 - DNA, 616 bp, Homo sapiens
  misc_feature: GZ8MTXP01C57YR.15.28.C06.1.454.CMB.2.raw
  modified_base (269)..(269): a, c, t, g, unknown or other
  modified_base (377)..(377): a, c, t, g, unknown or other
  modified_base (505)..(505): a, c, t, g, unknown or other
  modified_base (512)..(512): a, c, t, g, unknown or other
  modified_base (519)..(519): a, c, t, g, unknown or other
  modified_base (532)..(532): a, c, t, g, unknown or other
  modified_base (550)..(550): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagcttgggttttccttgttgctattttagaaggtgtccagtgtgaggtgcaacgtggtggagtcgtgggggagcctcgtccgaggccggggggtcctgagactctcctgtgaagcctntggacttcaccttgagctacttagttggatgtacgttcggtccgccgaggccgtccgaagggggacggggcgtggaggtgggtcgacccaacgaataaacgaaaaagngtaggaacgtcgaacactaaactagtagtacgaacttcgtggtagtagtcgggtacctacttccacccgtcctcctacgacgccctacccgaaccgtaaccgggccctacgtcccggtccctccccgnggccccnccggtcncctacgacggacnccgacctcgagcgcacgngcccgccgtggctcgccgtacggcaacgccttccttccgacgtaacgtacgcgttggcgcgggtcg

SEQ ID NO: 400697 - DNA, 724 bp, Homo sapiens
  misc_feature: GZ8MTXP01A1E3B.15.28.C06.1.454.CMB.2.raw
  modified_base (203)..(203): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtctccgtccaccctgtctgctatcgtggtacgganacagacgtcaccatcacttcggccggcagtcagtatattactaagtggtgctgtcagacaagaacgaggaacacccaaagtctagactctctcgccgtccttacttacgttcgacgtaacggttcgggtacctagtacgtaacgttcgacggccggtacgaggtgtacgtacggtaacgggaactaaggtaacgttacgtacgttaccctacaaccctagtaccacggaccaacggtcccgtaggaaccgtacgtacccgttacggtaccggtttaactttaccgaaaccctttaaaccgttaacgttaacccgtacgggtaacgttaagtaaccgtaacttaaacgttaaacttacttacggttaaccgggttccggggaacgggtaaacgggtaaccgtaagggggttaaacggaacgttaaacgttaaaccggaaacggttacgtacgggttacgttccgttacggaacccctactaacggtttcctaccgttacctttccgttaaccgtttcccccg

SEQ ID NO: 400698 - DNA, 629 bp, Homo sapiens
  misc_feature: GZ8MTXP01DVWVR.15.28.C06.1.454.CMB.2.raw
  modified_base (270)..(270): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctggtcggagacagatcaccatcacttcggccggcagtcagatattactaagtggttgctgttcagcaagaacaggaaacncccaaaagtcctagatctctcgccgtcctctactttacgacgtaaacggttcgggggtacccagttacgaaacggtttcgaggtcccggcggtaggtacggtacgtacggtaacggaactaaggtactacgtacgtacctaccactagaccgacgacgacgtcgacgacgtacgtaccgtaggttactttacggttactaaccttaacgttaactactaccgggtaaactaggtactaacttaataaactacgtagttacggtcgggaggtaacggacgtaagggaataagttactaaccgaaagtcgttcggacgttcgacgaacctaactgttactcttctaacttcgttaaccccg

SEQ ID NO: 400699 - DNA, 667 bp, Homo sapiens
  misc_feature: GZ8MTXP01B5BZE.15.28.C06.1.454.CMB.2.raw
  modified_base (273)..(273): a, c, t, g, unknown or other
  modified_base (280)..(280): a, c, t, g, unknown or other
  modified_base (285)..(285): a, c, t, g, unknown or other
tcagtctacgtagccacgaccggtgctcgatttagagctcacgtattgggtttggggggagtcagaatcagtcaggacacagcatggacatgagggtccccgctcagctcctggggctcctgctgctctggctcccaggtgccaaatgtgacatccagatgacccagtcctccgtccaccctgtctgcatctgtcggagacagagtcacatcactgccggcagtcagtatatactaatggtgctgtcagcagaacgaggaacacccaaagtcngatctcncgccncctactactttgacgtaaggtcgggtcccagtcgtaaggttcaggtccggagtaggtgacgtcggtaaggggaactaaggtaaacttcacgttcctaccaacatcgagccaacggcctgaccgacgtaccgtacggtacttaacgttttcaaccttaactttacaccgtacggtaaccgtaaaggtctaaacctaaattaacgtaaacgttcgttaacggtttccgggggaacgggtaaacggggaaccggtaaaggggtaacggtaacgttaaacgtaaacccggttaaaacgtaaccggttgggttacgttaccgttaccgggtaacccaacccttaactttccgttcggttaaccctttccttaacccggtttcccccg

SEQ ID NO: 400700 - DNA, 767 bp, Homo sapiens
  misc_feature: GZ8MTXP01B6BF4.15.28.C06.1.454.CMB.2.raw
  modified_base (198)..(198): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcacatcacttgccggcagtcagagtatactaaagtggtggctgttcagacaagaacgaggaaacgacccaaacgtcctagactctctcgcccgtcctcgttactttcgacgtaaacggttcgggtaccctagttaccgtaaggttccaggcccggacgtacggtggtaacgtcggtaacgggaacgtaaggtaatttaccgagttccgtaccaacctattccgaacgcgtaaccggaccgtcggtaccacggtaccccgttaggtaaccgtttaacgtttttaccggacccttaaaaccgttttaacctaacccggtttacggggaaaccccgtttaaggggtttacccgtaaagtttaaaaccgtttaaattaaaccgtttaacggtttaacggggttttaaacccgggggccggggggtaaaccgggtaaccgggtaaagggggttaacggaaacgtttacgaaaccggttaaacggtaacgttcgggttacgggttccttaacgggtcctaccgtaacggttttccgtcgtttaccgttccgttaacccgttttccccg

SEQ ID NO: 400701 - DNA, 540 bp, Homo sapiens
  misc_feature: GZ8MTXP01CQHTL.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgctggttcagcagaaaccaggaaagcccaaaagtcctgaatctctgccgctctactttgctaaaggtcgggtcccatcaaggttcagcggcgagtggatccgtagggacaagaattcacgtctcacatcagcagcctgcagcctagctactttgactaacttacgtactgaccaagtcgacaataactaatccagtttacggacgggtaagggaccgtaagggtggaacggatacgaaaacgaaacgtggttgggccttggccaactcacttggttacttccgaagtttccccg

SEQ ID NO: 400702 - DNA, 610 bp, Homo sapiens
  misc_feature: GZ8MTXP01CP7EZ.15.28.C06.1.454.CMB.2.raw
  modified_base (288)..(288): a, c, t, g, unknown or other
  modified_base (295)..(295): a, c, t, g, unknown or other
  modified_base (345)..(345): a, c, t, g, unknown or other
  modified_base (362)..(362): a, c, t, g, unknown or other
  modified_base (529)..(529): a, c, t, g, unknown or other
  modified_base (579)..(579): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtcctccgtccaccctgtctgcatcgtgtcggagacagagtcacatcacgttgccggcagtcagagtattaactaaagtggtgcctggttcagcaagaaacgaggaaacacccaaagtcctnagtcacncgccgctactacttgactaaggtcgggaccagtctaaaggtcaggtccgntaggtgatcgagggaanaacgtaattcgagttcctacaccagtacacgtacacgacgtggaccacgtactacgtaacgttaatttccgaacttaaacttacctaagtcgaaccgtaagtgaacttaaataaacttatacgttaacggttcggaaccgggtagggaaccgtaaggggtaaggaanaactaacgaaaccgttaaaggtggttacgacgttcgaaccgtaaccgttnttcgtaccgttacttaaccgttcttaacccg

SEQ ID NO: 400703 - DNA, 611 bp, Homo sapiens
  misc_feature: GZ8MTXP01AU9W7.15.28.C06.1.454.CMB.2.raw
  modified_base (369)..(369): a, c, t, g, unknown or other
  modified_base (391)..(391): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcgagacagacgtcaccatcacttgaccgggcagtcagatattactaaatggtgctggttcagcagaacaggaaacacccaaagtcctagactctctcgccgtctcttactttgacgtaaagttcggggtacccagttacaaggttcaggtccggacaggtggaactcgtaagggaacnggtaattccagtctacacctanacacgctacgctcgacgacgtacgtacgtacgttacgttacgtactaacttaactacgtacggtaacgtaacgtacgtaacgtaactaaagttaacgttacgtacgttacggtacggtaacgggtaacggaacgggtaaggtaagttacgtaaacgaaacgtaacgtacgttacgttcgttacgtaactactaacgtcgtcgttacttccgttccgtccg

SEQ ID NO: 400704 - DNA, 593 bp, Homo sapiens
  misc_feature: GZ8MTXP01D3Y1G.15.28.C06.1.454.CMB.2.raw
  modified_base (199)..(199): a, c, t, g, unknown or other
  modified_base (209)..(209): a, c, t, g, unknown or other
  modified_base (253)..(253): a, c, t, g, unknown or other
  modified_base (284)..(284): a, c, t, g, unknown or other
  modified_base (424)..(424): a, c, t, g, unknown or other
  modified_base (479)..(479): a, c, t, g, unknown or other
  modified_base (530)..(530): a, c, t, g, unknown or other
  modified_base (575)..(575): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagatcacntcacttcggccggcagtcagtagtattactaaagtggtgctgtnagcaagaacaggaacacccaaagtctgatcnctcgccgtctacttacttcgaacgtaacgggttcgggtacccagtacgtaacggttcacggcccggacgtaggtacggtactcggtaacggggaactaagtaaacgttcacggtcctaccaaccgatccaagtcaacgcncggcacgtccctagtacgttactttgaactaacttactacgtcgggaactagtanactaaataacgtagtcgttacggttacgggacggtaacggacgtagggaancgttaaataccgaaagtagtcgttaggcttacgctactcgttctnttctaacgttcgttcccg

SEQ ID NO: 400705 - DNA, 565 bp, Homo sapiens
  misc_feature: GZ8MTXP01BLR0K.15.28.C06.1.454.CMB.2.raw
  modified_base (200)..(200): a, c, t, g, unknown or other
  modified_base (280)..(280): a, c, t, g, unknown or other
  modified_base (290)..(290): a, c, t, g, unknown or other
  modified_base (295)..(295): a, c, t, g, unknown or other
  modified_base (297)..(297): a, c, t, g, unknown or other
  modified_base (358)..(358): a, c, t, g, unknown or other
  modified_base (413)..(413): a, c, t, g, unknown or other
  modified_base (416)..(416): a, c, t, g, unknown or other
  modified_base (426)..(426): a, c, t, g, unknown or other
  modified_base (446)..(446): a, c, t, g, unknown or other
  modified_base (536)..(536): a, c, t, g, unknown or other
  modified_base (546)..(546): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctccgtccaccctgtctgcatctgtcgganacagagtcaccatcacgttcggccgggcagtcagtagtattactaagtggttcgccttggttcagcagaacgagggaacncccaaagtcngatcncncggcctctctactttcggacaaacgggtcggtccagtacgtaacggttcaggtccccggtnaggggtgatcggtaagggacaagtaactcgacttcacacagtcagcagcctgacncgngacgtacgtnttcgactaactcctagtacncgaagtcaactaatacctaatacgtcgttacgggcggtacggtaacgagggtaacgagttagaaacgttaacgaagttcgacgcgttacnctacaacttntcttcctaacttcttcccg

SEQ ID NO: 400706 - DNA, 740 bp, Homo sapiens
  misc_feature: GZ8MTXP01DYPEQ.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatcgacccagtcctcccgtccaccctgtctgcatcgtggtcggagacagacgtccaccatcacgttcggccggcagtcagtagttattactaagtggttgtctgttcagacaacgaacgaggaaacacccgaaagtcctagatcctctcgcccgtccttacttacgttagacgtaaacgggttcgggtaccagtacgtaacggttcgacggccggacgtaggtggacgtccggtaaggggaacctaaggtaacttcgacgtcctaccacacgtcacgtccgaacgtccgtcggaccgtacggtacccgttacgggttaacgtttacgttttaccgaaaccttaaaccgtttaaccgtaaccgttacggggtaaaccctaagggttaaccgtaacctaaattaaacttaacgttacgtttaacggggtttaccgggggacggggtaaacgggtaaaccgggtaaggggtaacggtaaacggttaacggtaaacgttaaaacgggtaaccggttgggttaccgttcgttaccgtaaccctactaacgtttacggttcctttccttaaccttaaccgtttccccg

SEQ ID NO: 400707 - DNA, 650 bp, Homo sapiens
  misc_feature: GZ8MTXP01E1MS6.15.28.C06.1.454.CMB.2.raw
  modified_base (231)..(231): a, c, t, g, unknown or other
tcagtctacgtagccacgaccggtgctcgattttagagctcacgtattggggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtnagagtattactaaagtggttggcctggttcagcaagaaaccgaagggaaacgaccccaaaagtccctgactctctcgccgcctctactttgcgaaagtcgggtccagtcaaggtcacgccggcgagtggtagtcgtacgggacaagtaactctacgtctctaaccactacacgcagaccgtcgcgacgtccgtacgtacgttaacgtttagtacctaacctttaactaccgttacggtacgtaaacgtgtaacaattaaacgttaaattacgttaacggtttacggggtaccgggaagggggaacccggaaggggtaacgggaaggttaacgtaaacgttaaaccggtaaacgtaacggttcggacgttcgtaacccgtacccgtaacttcgttcggttcctttccgttcctttccccg

SEQ ID NO: 400708 - DNA, 600 bp, Homo sapiens
  misc_feature: GZ8MTXP01A3GCT.15.28.C06.1.454.CMB.2.raw
  modified_base (302)..(302): a, c, t, g, unknown or other
  modified_base (320)..(320): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggtttcctgttgctattttagaaggtgtccagtgtgaggtgcaactggtggagtctgggggagcctcgtccaggccggggggtccctgagactctcctgtgaagcctctggattcaccttgagcacttatggatgacttgggtccncaggctccagggagggcnggagtgggtgccaccgattaacaaaaagctaggaagtggacacaaccctatagtgaacgtctaggtgatgggggccctaagttccacccggtctccctcacggcccttcacccaaaggggtccccaagttccgggccttcccccgtgggtccgccccttgccgtcccagggacgccgaacctccggacgacgcgacctacggcgggccctcgggggctggccccgttggcttaacgggcttacgttcccggactcgtaacggcttcggaacgcgggccgg

SEQ ID NO: 400709 - DNA, 495 bp, Homo sapiens
  misc_feature: GZ8MTXP02HASRH.15.28.C06.1.454.CMB.2.raw
  modified_base (386)..(386): a, c, t, g, unknown or other
  modified_base (488)..(495): a, c, t, g, unknown or other
tcagtctacgtagccacgaccggtgctcgatttagagctcacgtattgggtttggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccaggggaaccctggtcaccgtctcctcagcctccaccaagggcccatcggtcttccccctggccnccctgctcccaggagcacctccgagagcacagcggccctgggctgccctggtcaaggactacttccgctacgtagactgagcgggctggcaaggcgcatagnnnnnnnn

SEQ ID NO: 400710 - DNA, 494 bp, Homo sapiens
  misc_feature: GZ8MTXP02G3CCD.15.28.C06.1.454.CMB.2.raw
  modified_base (356)..(356): a, c, t, g, unknown or other
  modified_base (421)..(421): a, c, t, g, unknown or other
  modified_base (486)..(486): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaaagtggggtccatcaaggttcagccgcagtggatctgggacngaattcagtctcaccatcagcagcctgcagcctgacgattttgcaacttactaactgccaaagtncaataataatcaatttcggcggagggacaaggtggagatcaaacgaactgtaggctgcacatctntctcactc

SEQ ID NO: 400711 - DNA, 604 bp, Homo sapiens
  misc_feature: GZ8MTXP02GSVFQ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaagttcagccggcagtggatcgtgggacagaattcagtctcaccatcagcagcctgcagccctgacgtattttcgactaaacttactactacgaccctaagtcgactaataaaacttaaatactaacgttttaccgggacgggtaacggggaacccgaaaggggttacggaacgggtaaattaaccgaaaaacggtaaaccgttaggttaacgggccgttacgggaaccgtaaacccgaagtttaccctaggtttcctttaccgaacgttttcccccg

SEQ ID NO: 400712 - DNA, 511 bp, Homo sapiens
  misc_feature: GZ8MTXP02HCAA4.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggcccatcaagttcagccggcagtgatctgggacngaattcagtctcacatcagcagcctgcagcctgacgtatttgactaacttactacttgacctaaagtcgacaataaataatctaagtttcggacggagggaccaagggtacggagatacaaaacgaactgtacggctgcacatctagtcttcacttccc

SEQ ID NO: 400713 - DNA, 512 bp, Homo sapiens
  misc_feature: GZ8MTXP02JMDEW.15.28.C06.1.454.CMB.2.raw
  modified_base (359)..(359): a, c, t, g, unknown or other
  modified_base (426)..(426): a, c, t, g, unknown or other
  modified_base (504)..(504): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaaagtggggtcccatcaaggttcagccggcagtggatctggggacngaaattcagtctcaccatcagcagcctgcagctgacgtatttgactaacttactactgaccaaagtnacaataaataatcaatttcgggacggaagggaccaaaggtggaagatacaaaacgactagtcggctagcaccatcttntctcactc

SEQ ID NO: 400714 - DNA, 511 bp, Homo sapiens
  misc_feature: GZ8MTXP02JC0ZN.15.28.C06.1.454.CMB.2.raw
  modified_base (355)..(355): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagcccccaaaagtcctgatctctgccgcctctactttgcaaagtggggtcccatcaaggtcagcggcagtgatctgggacngaattcagtctcaccatcagcagcctgcagcctgacgtattttgactaacttactacttgacccaagtgcaataaataatcagtttcggcggtagggaccgaaggtggagatacaaaacgacgtgtacggctagcaccagtctgtacttcattccc

SEQ ID NO: 400715 - DNA, 557 bp, Homo sapiens
  misc_feature: GZ8MTXP02GGKZ3.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacaggaaagaccccaaaagtcctgatctctgccgcctctactttgacaaaaggtcggggtacccatcaaggttcagccggcagtggatcgtggacagatcagtctcacatcagcagcctgcagcctgacgtatttcgactaacttactactgacccaagtcgactaataaataatctaagtttcgggacggaacgggtaaccgaaagggttacggaagaacttacgaaaacgtaacgtggttacgggactaggaaccgaacctaattccgtagttccttacctaactttccccg

SEQ ID NO: 400716 - DNA, 515 bp, Homo sapiens
  misc_feature: GZ8MTXP02IUJEW.15.28.C06.1.454.CMB.2.raw
  modified_base (358)..(358): a, c, t, g, unknown or other
  modified_base (381)..(381): a, c, t, g, unknown or other
  modified_base (426)..(426): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaaagccccaaaaagtcctagatctctgccgcctctactttgcaaagtggggtcccatcaaggttcagccggcagtggatctgggacngaattcagtctcaccatcagcancctgcagcctgacgattttgactaacttactacttgacctaagtnacaataaataatcaagtttcggacggtaagggaccgaaggtggagagtacaaaacgaactgtacggctgcacatctgtcttcactttcc

SEQ ID NO: 400717 - DNA, 504 bp, Homo sapiens
  misc_feature: GZ8MTXP02GHLYZ.15.28.C06.1.454.CMB.2.raw
  modified_base (355)..(355): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctagatctctgccgcctctactttgcaaagtggggtcccatcaaggtcagcgcagtgatctgggacngaattcagtctcacatcagcagcctgcagctcgacgatttgtcaacttactaacttgccaagtgacataataatacattacgtcgagggaccgaaggtaggagagacaaacgaaactacgtacggcgcgcgacactctcgtctctactc

SEQ ID NO: 400718 - DNA, 596 bp, Homo sapiens
  misc_feature: GZ8MTXP02J0AV9.15.28.C06.1.454.CMB.2.raw
  modified_base (353)..(353): a, c, t, g, unknown or other
  modified_base (440)..(440): a, c, t, g, unknown or other
tcagtctacgtagccacgaccggtgctcgatttagagctcacgtattgggtttggggagtcagactcagtcaggacacagcatggacatgagggtccccgctcagctcctgggctcctgctgctctggctccaggtgccaaatgtgacatccagatgaccccagtctccgtccaccctgtctgcatctgtcggagacagagtcaccatcacttgccgggcagtcagagtattactaaatggttgcctggttcagcaagaaaccagggaaacgccccaaaagtcctgatctctgccgcctctactttgcaaaaggtcggggtcccatcaaaggttcagcccggcagtggggtanacgcggggacaggaaatcttaagctacacatcagcagccctgcagcctgtacgattttcgactaaactactaactgacaccggttanactaatctactacgtacgttcgggacgggtaacgggaacggtaagggtacggaacgtacaccgtaaaccggtaaacgaacggtacggtaccgtaccggtaaccgtaacccgtacgttaccgtttaccgtttacccgtttaccgttacccgaacccg

SEQ ID NO: 400719 - DNA, 512 bp, Homo sapiens
  misc_feature: GZ8MTXP02HQS98.15.28.C06.1.454.CMB.2.raw
  modified_base (358)..(358): a, c, t, g, unknown or other
  modified_base (429)..(429): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctagatctctgccgcctctactttgcaaagtggggtcccatcaaggttcagccggcagtggatgtggggacngaattcagtctacaccatcagcagcctagcagcctgacgtattttgactaacttactactgacctaaggtnacaataataatctaagtttcggacggagggaccaagggtggaagatacaaagactgtacggctgcacatctgtctctacttcc

SEQ ID NO: 400720 - DNA, 513 bp, Homo sapiens
  misc_feature: GZ8MTXP02IHWDV.15.28.C06.1.454.CMB.2.raw
  modified_base (358)..(358): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaaagtggggtcccatcaaggttcagccggcagtggatcgtgggacngaattcagtctcaccatcagcagcctgcagcctgacgtattttgactaacttactactgccaaagtgacataaataatctatttcggacggagggtaccaaagggtggaagatacaaaacgaactgtaggctgcacaatctgtcttctacttccc

SEQ ID NO: 400721 - DNA, 533 bp, Homo sapiens
  misc_feature: GZ8MTXP02G2BMC.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtccatcaagtcagccggcagtggatctgggacagaattcagtctcacatcagcagcctgcagcctgacgtattttgactaacttactactgacctaagtgactaataaactaatctaagttttcgggacgggtaaggggaccaaagggttcggaagatacgaaaacgaaacgtggtacgggcttacggcaaccattctagtacttcactttccc

SEQ ID NO: 400722 - DNA, 518 bp, Homo sapiens
  misc_feature: GZ8MTXP02I9TBH.15.28.C06.1.454.CMB.2.raw
  modified_base (356)..(356): a, c, t, g, unknown or other
  modified_base (424)..(424): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaaagtggggtcccatcaaggttcagccggcagtggatcgtgggacngaaattcagtctcacatcagcagcctgcagcctgacgtatttgctaacttacacttgacctaaaggtnactaataaataatcaagtttcggacggtaagggaccaaagggtggaagatacgaaaacgaactcgtaggctgcaccatctgtcttcactttccg

SEQ ID NO: 400723 - DNA, 532 bp, Homo sapiens
  misc_feature: GZ8MTXP02HOD1Y.15.28.C06.1.454.CMB.2.raw
  modified_base (434)..(434): a, c, t, g, unknown or other
  modified_base (487)..(487): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggtgcctggttcagcagaaacaggaaacaccccaaaagtcctagatctctcgccgcctcttactttgactaaaggtcggggtcccatacgaaggttcagccggacagtggatcgtagggacagtaattcagtctacacatcagcagcctgcagctgacgtatttcgactaaacttactactcgacctaaagtnactaaataactaaatctaagtttcgggacggaagggaccaaagggtgaagtanaacaaacgaactgacgctagaacacactctagttctactactccc

SEQ ID NO: 400724 - DNA, 509 bp, Homo sapiens
  misc_feature: GZ8MTXP02JGK9L.15.28.C06.1.454.CMB.2.raw
  modified_base (353)..(353): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaaagtcctgatctctgccgcctctactttgcaaagtggggtcccatcagttcagccggcagtgatctgggacngattcagtctcacatcagcagcctgcagctgacgatttgactaacttactactgcctaaagtgacataaataactacagtttcggacggtaggggaccaaggtcggagatacaaaacgaactcgtaggctggcactatctagtcttacactttccc

SEQ ID NO: 400725 - DNA, 498 bp, Homo sapiens
  misc_feature: GZ8MTXP02I0DO8.15.28.C06.1.454.CMB.2.raw
  modified_base (390)..(390): a, c, t, g, unknown or other
  modified_base (491)..(498): a, c, t, g, unknown or other
tcagtctacgtagccacgaccggtgctcgatttagagctcacgtattgggtttggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaaacaaaccctgagagccgaggacacggctgtgtattactgtgtgagagatgttctgcgttggggcccaggggaaccctgggtcaccgtctcctccagcctcaccaggcccatcggtctccccctggccnccctgctccagagcacctcgagagcacagccggccctgggctgcctggtcaaggcctacttcccgctacgtagactgagcggggctggcaaggcgcatagnnnnnnnn

SEQ ID NO: 400726 - DNA, 570 bp, Homo sapiens
  misc_feature: GZ8MTXP02ICCIH.15.28.C06.1.454.CMB.2.raw
tcagtctacgtagccacgaccggtgctcgatttagagctcacgtattgggtttgggggagtcagactcagtcaggacacagcatggacatggacgggtccccgctcagctccgtggggctcctgctgctctggctcccaggtgccaaatgtgacatccagatgacccagtctccgtccaccctgtctgcatctgtcggagacagagtcaccatcacttgcccgggccagtcagagtattactaatggttggcctggttcagcagaaaccagggaacgaccccaaaagtcctagatctctcgccgcctctactttgacaaaaggtcggggtacccatcgaaggttcagcccggcagtggactcgtggggacagtaattcagtctacacatcagcagccctgcagcctgacgttattttgactaacttacctactcgaccctaagtgacctaaattaactaatctaagtttcggacgggaacgggaccgaagggtagggagataaccgaaaacggtacgtacggtacggccgtagcctaaccgaacttctcggttcctttacaactttcccc

SEQ ID NO: 400727 - DNA, 538 bp, Homo sapiens
  misc_feature: GZ8MTXP02F40C8.15.28.C06.1.454.CMB.2.raw
  modified_base (358)..(358): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagaccccaaaagtcctgatctctgccgcctctactttgacaaagtggggtcccatcaaggttcagccggcagtggatcgtagggacnggaattcagtctcacatcagcagcctgcagcctgacgtattttcgactaacttactactgacctaagtcactaataaactaatctaagtttcgggacgggtaagggaaccgaagggtacggaaggattacgaaaacggactaggtacggctagaacaccattcctgtacttcatttcccg

SEQ ID NO: 400728 - DNA, 538 bp, Homo sapiens
  misc_feature: GZ8MTXP02J4W47.15.28.C06.1.454.CMB.2.raw
  modified_base (344)..(344): a, c, t, g, unknown or other
  modified_base (355)..(355): a, c, t, g, unknown or other
  modified_base (376)..(376): a, c, t, g, unknown or other
  modified_base (433)..(433): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttcgccgggccagtcagtagtattactaaatggttggcctggttcagcaagaaaccaggaaacgccccaaaagtcctgatctctcgccgctctactttgcaaagtcgggtaccatcaaggtcagcggcagngatctgggacngaattcagtctacaccatcancagccctcgcacgcgtacgtacgtacttacgtactaacttactactacgactagtanactaataataactacgtacgttacggacgggacggaacggaaggtacgagacgaacgaaacgaacgtacgtacgacgtacgaacgactactctctctactactcc

SEQ ID NO: 400729 - DNA, 563 bp, Homo sapiens
  misc_feature: GZ8MTXP02H036Z.15.28.C06.1.454.CMB.2.raw
  modified_base (351)..(351): a, c, t, g, unknown or other
  modified_base (354)..(354): a, c, t, g, unknown or other
  modified_base (375)..(375): a, c, t, g, unknown or other
  modified_base (382)..(382): a, c, t, g, unknown or other
tcagtctacgtagccacgaccggtgctcgatttagagctcacgtattgggtttggggtgagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtggcctggttcagcagaaaccaggaaagccccaaaaagtcctgatctctgccgcctctaactttgcaaaagtggggtcccatcaaaggttcagcggcagtggatcnggngagaatcatctcaccacacanacacgcncgcacgcgtacgtacgtatttagtactaaacttaactactacgacaagtacgactaataaataaatactacgttacggtacgggaacgggaaacggaaacggtaaggaagaaacgtaaacgtaaaacgtaaacgtacgtacggtacgtaacgtacgaacctactacgtcgttacttactac

SEQ ID NO: 400730 - DNA, 527 bp, Homo sapiens
  misc_feature: GZ8MTXP02G7BIB.15.28.C06.1.454.CMB.2.raw
tcagtctacgtagccacgaccggtgctcgatttagagctcacgtattgggtttgggggagtcagaatcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggttggcctggttcagcagaaaccagggaaacgaccccaaaagtcctgatctctgccgcctctactttgcaaagtggggtcccatcaaggttcagccggcagtggatcgtagggacagaattcagtctcacatcagcagcctgcagctgacgtatttgactaacttactactgaccaagtgactaaataataatactagtttcggggacgggaggggaaccaaggggttacggaagatacgaaaaccgtaatcggtacggctagcgaccatctgtcctcactttccc

SEQ ID NO: 400731 - DNA, 561 bp, Homo sapiens
  misc_feature: GZ8MTXP02J5LTH.15.28.C06.1.454.CMB.2.raw
  modified_base (356)..(356): a, c, t, g, unknown or other
tcagtctacgtagccacgaccggtgctcgatttagagctcacgtattggggtttgggggtagtcagactcagtcaggacacagcatggacatgagggtccccgctcagctcctggggctcctgctgctctggctcccaggtgccaaatgtgacatccagatgaccccagtctccgtccaccctgtctgcatctgtcggagacagagtcaccatcacttgccgggccagtcagtagtattactaaatggttggcctggttcagcaagaaaccagggaaagccccaaagtcctgatctctgccgcctctactttgcaaagtggggtcccatcaaggtcagcggcagtgatctgggacngaattcagtctcaccatccagcagcctgcagcgtgtacggtatttagtactaacttacttactcgcacgtagactaataataactacgtacgttacgggtacgggacgggaacgggaacggtaacgggtaggaacgtaacgtaaacgtaaacgtacgtcggtcgtacgtccgtacctacttcttcgttcctttcctaccttcccg

SEQ ID NO: 400732 - DNA, 510 bp, Homo sapiens
  misc_feature: GZ8MTXP02I31NS.15.28.C06.1.454.CMB.2.raw
  modified_base (358)..(358): a, c, t, g, unknown or other
  modified_base (371)..(371): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaaagtggggtcccatcaaggttcagccggcagtggatctgggacngaaattcagtctnaccatcagcagcctgcagccctgacgattttgcacttacacttgccaagtgcataaataatcatttcggcggagggaccaaggtcggagatacaaaaccgaaactgtaggctaggcaccatcctgtcttacatttcccg

SEQ ID NO: 400733 - DNA, 566 bp, Homo sapiens
  misc_feature: GZ8MTXP02IIOVY.15.28.C06.1.454.CMB.2.raw
  modified_base (255)..(255): a, c, t, g, unknown or other
  modified_base (383)..(383): a, c, t, g, unknown or other
  modified_base (386)..(386): a, c, t, g, unknown or other
tcagtctacgtagccacgaccggtgctcgatttagagctcacgtattgggtttgggggagtcgagactcagtcagggacacgagcatggacatgagggtccccgctcagctcctggggctcctgctgctctggctcccaggtgccaaatgtgacatccagatgacccagtctccgtccacctgtctgcatcgtgtcggagacagagtcaccatcacttgccgggcagtcagagtattactaaatggtgctggttnagcagaacaggaaacacccaaaagtcctgatctctgccgcctctactttgactaaaaggtgggtacccatcaaggtcagccggcagtggatcgtgggacagtaattcagtctacacatcagcagccgngcncgctagtacgtattcgactaacttactactcgactaagtcactaataataagtactagttacgggacggaacgggtaacgtaagggtacggaagtacgtaaacgtaaaacgtaacgttacggtacggtacgtacgaaccgtaacgtacgttcgttacgtttaccttacgtaccgttcccg

SEQ ID NO: 400734 - DNA, 504 bp, Homo sapiens
  misc_feature: GZ8MTXP02I7ZV4.15.28.C06.1.454.CMB.2.raw
  modified_base (359)..(359): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgtagacagagtcaccatcacttgccgggccagtcagagtattactaaatggttggcctggtttcagcagaaaccagggaaagcccccaaaaagtcctgatctctgccgcctctactttgcaaaagtggggtcccatcaaggttcagccggcagtggatctgggacngaattcagtctcacatcagcagcctgcagcctgacgattttgctaacttactactgcccaaagtgcataataatcaatttcggcggtagggaccaaggtcggagatcaaaacgactgtacggctgcacatctgtcttcattcccg

SEQ ID NO: 400735 - DNA, 557 bp, Homo sapiens
  misc_feature: GZ8MTXP02H0E30.15.28.C06.1.454.CMB.2.raw
  modified_base (267)..(267): a, c, t, g, unknown or other
  modified_base (348)..(348): a, c, t, g, unknown or other
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacctgtctgcatctgtcggagacagagtcaccatcacttgccgggcagtcagagtatactaaatggtgcctggttcagcagaaacaggaaancccaaaagtctgatctctgccgcctctactttgcaaagtcggggtcccatcaaggttcagccggcagtggatcgtgggacngaattnagttctacacatcagcagcctgcagcctgacgtatttcgactaaacttactactgacctaaagtgacaataaataaatctaagtttcgggaccggaaggggaacccaaaaggggttggaaacgtagtaaccgaaaacggtaacgtaggtacggcgttacgaaccgaacctaacgttccgtggttacctttctaactttccccg

SEQ ID NO: 400736 - DNA, 487 bp, Homo sapiens
  misc_feature: GZ8MTXP02JE69J.15.28.C06.1.454.CMB.2.raw
  modified_base (430)..(430): a, c, t, g, unknown or other
tcagtctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgatccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagcgcagtggatctgggcagaattcagtctcacatcagcagcctgcagcctgacgatttgctaacttactactgccaagtgacataatatcattcggngtagggaccaaggtgagatacaaacgactgtaggcctgcaccgatctcgtcttctac

SEQ ID NO: 400737 - DNA, 518 bp, Homo sapiens
  misc_feature: GZ8MTXP02GGD7C.15.28.C06.1.454.CMB.2.raw
  modified_base (506)..(506): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagccggcagtggatctgggacagaattcagtctcaccatcagcagcctgcagcctgacgtattttgacaacttactactgcccaagtgacaataaataatacagtttcggacggtagggaccaagggtcggagaatacgaaaacgaactgtaggctagcaccgatccgttntctactactccg

SEQ ID NO: 400738 - DNA, 522 bp, Homo sapiens
  misc_feature: GZ8MTXP02I9565.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaacgaccccaaaaagtcctagatctctgccgcctctactttgcaaagtggggtcccatcaaggtcagcgcagtgatctggacagattcagtctacaccatcagcagcctgcagcctgacgtattttgactaacttactaactgaccaagtcacaataaataaatctaagtttacggcggaagggtaccaaagggtcggaagatacgaaaacgaactcgtaggctgaacaccatcgactcttacactttcccg

SEQ ID NO: 400739 - DNA, 573 bp, Homo sapiens
  misc_feature: GZ8MTXP02GMBBJ.15.28.C06.1.454.CMB.2.raw
  modified_base (277)..(277): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaaatgtgacatccagatgacccagtctccgtccaccctgtctgcatctgtcggagacagagtcaccatcacttgccgggccagtcagagtattactaaatggttggcctggtttcagcagaaaccagggaaanccccaaaaagtcctagatctctgccgcctctactttgacaaagtggggtcccatcaaggttcagccgcagtgatcgtgggacagaattcagtctcacatcagcagccacgcagctcgacgtactttgtactaacttaacttactacgtacaacgtagtactaataaattaaatactaacgtttacggtacggtaacgggaaccgtaaacggttacggtaaggaagtaacgtaaaacgaaaccgtacgttaggcgtacggaacgaccgaacgtacgttacgtacttctactttcccg

SEQ ID NO: 400740 - DNA, 501 bp, Homo sapiens
  misc_feature: GZ8MTXP02HR4JH.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctctgtccaccctgtctgcatctgtcggagacagagtcaccatcacttgccgggccagtcagagtattactaatggtggctggttcagcagaaaccaggaaacgaccccaaaagtcctgatctctgccgcctctactttgcaaagtgggtaccatcaaggttcagcgcagtggatcgtgggcagaattcagtctcaccatcagcagcctgcagcctgacgtattttgactaactttactactgaccaagtgacaataataatcatttcgggacggtagggaccaagggtggagactacgaaacgactgtggctgcactactctcgtcttcgtac

SEQ ID NO: 400741 - DNA, 594 bp, Homo sapiens
  misc_feature: GZ8MTXP02I2EAF.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggccttggttcagcaagaaaccgagggaaacgaccccaaaagtcctgatctctcgccgtcctctactttgacgaaaggtcgggtccatacgtaaggtcagccggcaggtggatcgtaggacagtaacttcagtcctccaacatcaagcacgcctgcagtcctgacgttatttacgactaactttactacctcgaccctaagtcgactaaattaaactaacttctaacggtttacgggacggggtaacggaaccgtaaaggggtacggagtaaactaacgaaaacgtacgttggtacggacgtcgaaccgtaaccctagttcctcgttacctttacctaactttccccg

SEQ ID NO: 400742 - DNA, 534 bp, Homo sapiens
  misc_feature: GZ8MTXP02JHMBS.15.28.C06.1.454.CMB.2.raw
  modified_base (279)..(279): a, c, t, g, unknown or other
  modified_base (335)..(335): a, c, t, g, unknown or other
  modified_base (417)..(417): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggttgctggttcagcagaacaggaacaccccaaaagtcngatctctcgccgcctctactttgactaaaggtcggggtccatcaaggtcagccggnagtgatcgtgggacagaattcagtctcacatcagcagcctgcagcctagacgttatttgactaacttacactgacctaagtnactaaataataatactagtttacgggacgggtaagggaccaagggtacggaggaatacgaaaacggtaacgtgtacggtacacggaactaccattcctgtttacctctacttccccg

SEQ ID NO: 400743 - DNA, 514 bp, Homo sapiens
  misc_feature: GZ8MTXP02JSTA9.15.28.C06.1.454.CMB.2.raw
  modified_base (355)..(355): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggtcagccggcagtgatctgggacngaattcagtctcaccatcagcagcctgcagcctgacgtattttgctaacttactactgaccaagtgacaataataatctaagtttcgggacggagggaccaagggttggagatacgaaacgaaactgtacggctgaacaccatctgtcttacatttccc

SEQ ID NO: 400744 - DNA, 512 bp, Homo sapiens
  misc_feature: GZ8MTXP02GUVRV.15.28.C06.1.454.CMB.2.raw
  modified_base (359)..(359): a, c, t, g, unknown or other
  modified_base (372)..(372): a, c, t, g, unknown or other
  modified_base (424)..(424): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagccccaaaaagtcctgatctctgccgcctctactttgcaaaagtggggtcccatcaaggttcagccggcagtggatctgggacngaaattcagtctnaccatcagcagccctgcagcctgacgattttgcaacttacactgccaaagtnacataataatctagttcggacggacgggacgaaggtacggagatacgaaacgactacgtacgctgaacgaccatctgtctctactccg

SEQ ID NO: 400745 - DNA, 496 bp, Homo sapiens
  misc_feature: GZ8MTXP02ISDW6.15.28.C06.1.454.CMB.2.raw
  modified_base (352)..(352): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtggggtcccatcaaggttcagcgcagtgatctgggacngaattcagtctcacatcagcagctgcagcctgacgatttgcaacttactactgaccaagtgacataaatatcatttcggcggaagggaccaaggtcggagatacgaaaacgactgtcggctgcaccatactgtcttcacttccc

SEQ ID NO: 400746 - DNA, 538 bp, Homo sapiens
  misc_feature: GZ8MTXP02G031T.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctagatctctcgccgcctctactttgacaaaggtcggggtacccatacaaggttcaggccggcagtggatcgtggacagtaattcagtctacacatcagcagcctgcagctgacgtatttgactaacttactactgaccaagtgactaataaactaatctaagtttcgggacggtaggggaaccaaggggtaggaagagtacgaaaacggactggtacggctcgaactaccatctgttcttctactttccc

SEQ ID NO: 400747 - DNA, 603 bp, Homo sapiens
  misc_feature: GZ8MTXP02IA7OE.15.28.C06.1.454.CMB.2.raw
  modified_base (385)..(385): a, c, t, g, unknown or other
  modified_base (408)..(408): a, c, t, g, unknown or other
  modified_base (458)..(458): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtcgtgggggaggcctcgtccaggccggggggtccctggagactctcctgtgaagcctctggattcaccttgagcacttatggatgacttgggtccgcaggctccgaggggagggctggaggtgggtgccaccaataaacaaaaagataggaagtgaacacaactatgtagactntgtgagtgggcattccaccgtcncctcacgccctcccaccgaacgggcccacgttccgggtcccttcccccgnggcccgcccgtcgcctccgacggacgccacccgtccgacgacgccacgacggcccggtcccgtgggggcctacggcccgttacgggtaccgaaacgggtaccttaaccgttcccgacttaacggtacgaccgtggacggcgggcg

SEQ ID NO: 400748 - DNA, 547 bp, Homo sapiens
  misc_feature: GZ8MTXP02I8RAA.15.28.C06.1.454.CMB.2.raw
  modified_base (396)..(396): a, c, t, g, unknown or other
  modified_base (421)..(421): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaagccccaaaagtcctagatctctgccgcctctactttgcaaaagtgggtcccatcaaggtcagccggcagtggatcgtgggacagaattcagtctcacatcagcagctgcagctcgacgtatttntacaacttactactagaccaagtanactaataaataatactacgttacggtacgggaacgggaacgaaggtacggaagaacgtaaacgaaaacgtaaacgtacgtacggtacgtacgaacgtactactacgtacgttacttactactaccg

SEQ ID NO: 400749 - DNA, 525 bp, Homo sapiens
  misc_feature: GZ8MTXP02I0RT3.15.28.C06.1.454.CMB.2.raw
  modified_base (420)..(420): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagttgacccagtctccgtccaccctgtctgcatctgtcggagacagagtcaccatcacttgccgggccagtcagagtattactaaatggttggcctggttcagcagaaaccagggaaagccccaaaagtcctgatctctgccgcctctactttgcaaagtgggtcccatcaaggttcagcgcagtgatctggacagattcagtctcacatcagcagcctgcagccctgacgattttgacctaaacttactacttgaccaaagttnacaataataaatctatttcgggacggagggaaccaaagggtggaagtaatacgaaaacgtaaactcggtaggctggacaaccgatctcgtacttcactcttcccg

SEQ ID NO: 400750 - DNA, 511 bp, Homo sapiens
  misc_feature: GZ8MTXP02FKPW2.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctagatctctgccgcctctactttgcaaagtgggtccatcaaggttcagccggcagtggatcgtgggacagaattcagtctcaccatcagcagcctgcagcctgacgtattttgactaacttactactgaccaagtgacaataaataatctatttcggaggagggaccgaagggtaggagatacgaaaacgaactgtacggctagcaccaatctgtactcattccc

SEQ ID NO: 400751 - DNA, 531 bp, Homo sapiens
  misc_feature: GZ8MTXP02I0339.15.28.C06.1.454.CMB.2.raw
  modified_base (418)..(418): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggtgctgttcagcagaacaggaaacgaccccaaaagtcctgatctctcgccgcctctactttgacaaaagtggggtcccatcaaggttcagccggcagtgatctgggacagaattcagtctcacatcagcagcctgcagcctgacgtatttgactaacttactactgacctaagtnactaataaataatactagtttcgggacggtaagggaccaaagggtacggaggaatacgaaaacgtaacgtgtacggctaggaaccaacctatctagttcttactactttcccg

SEQ ID NO: 400752 - DNA, 511 bp, Homo sapiens
  misc_feature: GZ8MTXP02JAI3A.15.28.C06.1.454.CMB.2.raw
  modified_base (349)..(349): a, c, t, g, unknown or other
  modified_base (419)..(419): a, c, t, g, unknown or other
  modified_base (498)..(498): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtatactaatggtgctggttcagcagaacaggaaacgaccccaaaagtcctgatctctcgccgcctctactttgacaaaggtcgggtccatcaagttcagccggcagtgatcgtgggacngaattcagtctcaccatcagcacgcctgcagcctgacgtatttcgactaacttactactcgaccaagtanactaaataataatctagtttcggacggagggacaagggtgagatacgaaaacgtacgtgtacggctgaaccacatcgtntcttcactttccc

SEQ ID NO: 400753 - DNA, 511 bp, Homo sapiens
  misc_feature: GZ8MTXP02H5S7X.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtattactaaatggtggcctggttcagcagaaaccaggaaagaccccaaaagtcctgatctctgccgcctctactttgcaaagtggggtcccatcaaggtcagccggcagtggatctgggacngaattcagtctcaccatcagcagcctgccagccctgacgtattttgacaactttactactgcctaaagtgacaataaataatctaagttcggacggaagggacaaagggtcgagatacaaaacgaactgtaggctgcacatctagtcttcacttccc

SEQ ID NO: 400754 - DNA, 556 bp, Homo sapiens
  misc_feature: GZ8MTXP02G1K7A.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaatggtgcctggttcagcagaaccaggaaacgaccccaaaagtcctagatctctcgccgcctctactttgactaaaggtcggggtcccatacgaaggttcaggccggcagtggatcgtagggacaggtaattcagtctcacatcagcacgcctgcacgcctgacgttatttcgactaaactttactactgacctaagtcgactaataataacgtctagtttacgggacggtaagggaccgtaagggtacggaagaactacgaaaacgtacgtaggtacggctacggaacgacctacttctgtaccttctactttccccg

SEQ ID NO: 400755 - DNA, 535 bp, Homo sapiens
  misc_feature: GZ8MTXP02GVYD5.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtaggagacagagtcaccatcacttgccgggccagtcagagtattactaaatggttggcctggttcagcagaaaccagggaaagaccccaaaagtcctagatctctgccgcctctactttgacaaagtcggggtcccatcaaggttcagccggcagtggatcgtgggacagaattcagtctcaccatcagcagcctgcagcctgacgtattttgactaactttactactagacctaaagtgactaataaattaatctaagtttcgggacggtaaggggaccaaagggtcggagatacgaaaacgactagtcggactgaaccactactctagtcttacacttccc

SEQ ID NO: 400756 - DNA, 536 bp, Homo sapiens
  misc_feature: GZ8MTXP02HHJQV.15.28.C06.1.454.CMB.2.raw
  modified_base (270)..(270): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaacaggaaanccccaaaagtcctagatctctcgccgcctctactttgacaaagtggggtcccatcaaggttcagccggcagtggatctgggacagaattcagtctcacatcagcagcctcgcagctcgacgtatttgtactaacttacttactcgactaacgtagacaataaataatactacgttacggtacggacgggacgaaggtacggagaagtacgaaacgaaacgtacgtaggacgtcggaacgacaactactacgtactactacttcccg

SEQ ID NO: 400757 - DNA, 500 bp, Homo sapiens
  misc_feature: GZ8MTXP02HG49B.15.28.C06.1.454.CMB.2.raw
  modified_base (476)..(476): a, c, t, g, unknown or other
  modified_base (489)..(489): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggctggttcagcagaaaccaggaaacgaccccaaaagtcctgatctctcgccgcctctactttgcaaagtggggtccatcaaggttcagccggcagtggatcgtgggacagaattcagtctcacatcagcagctgcagcctgacgtatttgactaacttactactgacctaagtgacaataaataatctatttcgggaggtaggacgaaggtggagatacaaacgactgngctagcacatctntctcacttccc

SEQ ID NO: 400758 - DNA, 556 bp, Homo sapiens
  misc_feature: GZ8MTXP02JGNKK.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaatggtgctggttcagcagaacaggaaacaccccaaaagtcctagatctctcgccgcctcttactttgacaaaaggtcggggtacccagtacgtaaggttcaggccggcgaggtggatcgtaggggacaggtaattcagtcctacaccatcagcagcctgcagcctagacgtatttcgactaacttactactcgacctagtcactaataataatctagttcgggacggaacgggacaaggggtggaagtacgtaacgaaacggtaacgtcggtacggtctacggaacaacctacttcgtagttaccttacactttcccg

SEQ ID NO: 400759 - DNA, 506 bp, Homo sapiens
  misc_feature: GZ8MTXP02JEKKZ.15.28.C06.1.454.CMB.2.raw
  modified_base (354)..(354): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaagtggggtccatcaaggttcagcgcagtggatctgggacngaattcagtctcacatcagcagcctgcagcctgacgattttgcaacttactacttgacccaaagtgactaataaataatacagtttcggacggtagggaccaaggtacggagatacgaaacgactgtacgctgcgacatctgtcttcattcc

SEQ ID NO: 400760 - DNA, 503 bp, Homo sapiens
  misc_feature: GZ8MTXP02JJUQ3.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggcctggttcaacagaaaccagggaaacgccccaaaagtcctgatctctgccgcctctacttgcaaagtgggtcccatcaaggttcagcggccagtggatcgtggacagattcagtctcacatcagcagcctgcagccctgacgtattttgactaacttactactgaccaagtgactataataatcagtttcggacggtagggacaagggtgagatacaaacgacgtgtacgctgcaacatctgtctcacttctcccg

SEQ ID NO: 400761 - DNA, 519 bp, Homo sapiens
  misc_feature: GZ8MTXP02IC4GR.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccccgtctgcatctgtcggagacagagtcaccatcacttgccgggccagtcagagtattactaaatggttggcctggtttcagcagaaaccagggaaacgaccccaaaagtcctgatctctgccgcctctactttgacaaagtggggtcccatcaaggttcagcgccagtgatcgtggacagattcagtctcaccatcagcagcctgcagcctgacgtatttgctaactactactgccaaagtgacataaataatcaatttcgcggtaggaccaaaggtgaagatacgaaaacgtaaacgtgtggactgacaaccgaatcttgtacttcaacttccttccccg

SEQ ID NO: 400762 - DNA, 494 bp, Homo sapiens
  misc_feature: GZ8MTXP02I7NWI.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaaagccccaaaagtcctgatctctgccgcctctactttgcaaaagtggggtcccatcaaggtcagcgcagtggatctgggacagaattcagtctcacatcagcagcctgcagcctgacgatttgcaacttactactgccaaagtgcaataaataatcatttcggcggagggaccaaggtggagaatcaaaagaaactgtggctgcaccatctgtcttcattcc

SEQ ID NO: 400763 - DNA, 603 bp, Homo sapiens
  misc_feature: GZ8MTXP02G64LN.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcagaacaggaaacaccccaaaagtcctgatctctcgccgcctctactttgactaaaggtcggggtcccatcgtaaggttcaggccggcaggtggatcgtagggacaggaattcagtcctacaccatcagcacgcctagcagcctgacgtatttcgactaacttactacgtcgacctaaggtcactaaattaaactaatacgttacgtttacgggaccgggtaaggggaacccgtaaggggtaggaaacgtagtaaacccgtaaaacggtaaccgttaggtacggtacgttacggaaccgtaacccgtaacttccgttacggtttacctttccgtaactttcccccg

SEQ ID NO: 400764 - DNA, 561 bp, Homo sapiens
  misc_feature: GZ8MTXP02IQJO0.15.28.C06.1.454.CMB.2.raw
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccgagggaggggctggagtgggtggccacatacaaaagatggaagtgacacaaacctatgtagactctgtgatgggggccattcaccgtctccctcacgccctccaccgaacgggcccactccggtccttcccccgtggcccgcccctgcctcccaggacgccaccgtccgagacgccacgagccggcccgtggggcctcggcctggtccaacggctacgtccgctacgtacgactgacggcggtcg

SEQ ID NO: 400765 - DNA, 539 bp, Homo sapiens
  misc_feature: GZ8MTXP02JCL9P.15.28.C06.1.454.CMB.2.raw
  modified_base (522)..(522): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaagggaaaacgaccccaaaagtcctagatctctcgccgcctctactttgacaaagtcggggtcccatcgaaggttcaggccggcagtggatcgtgggacaggaattcagtctcaccatcagcagcctgcagcctgacgtattttgactaacttactactgaccaagtgacaattaaatatactagtttcggacggtaggacgaagggtggaagatacgaaaacgtaacgtagtacggctaggaaccacacttcgtntccttacactttccccg

SEQ ID NO: 400766 - DNA, 529 bp, Homo sapiens
  misc_feature: GZ8MTXP02JNWUD.15.28.C06.1.454.CMB.2.raw
  modified_base (355)..(355): a, c, t, g, unknown or other
  modified_base (367)..(367): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctagatctctgccgcctctactttgcaaagtggggtcccatcaaggttcagccggcagtgatctgggacngaattcagtctnaccatcagcagcctgcagcctgacgtattttgactaacttactacttgaccctaaagtgactaataaataatctaagtttcgggacggtaagggtaccaagggttacggagtatacgaaaacggaaactgtacggctgcaccgatctgtcttcactttcccg

SEQ ID NO: 400767 - DNA, 512 bp, Homo sapiens
  misc_feature: GZ8MTXP02JUAGE.15.28.C06.1.454.CMB.2.raw
  modified_base (429)..(429): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctgccgcctctactttgacaaaggtcggggtccatcaaggttcagccggcagtggatcgtgggacagaattcagtctcacatcagcagcctagcagcctgacgtattttgactaacttactacttgaccaaagtnacaataaataatctagtttcggcggtaaggacaagggtggagatacgaaagactgacggctagcaccatctgtctcatttccc

SEQ ID NO: 400768 - DNA, 567 bp, Homo sapiens
  misc_feature: GZ8MTXP02I693Z.15.28.C06.1.454.CMB.2.raw
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcagaacaggaaacgaccccaaaagtcctagatctctgccgcctctactttgacaaaggtcggggtcccatcaaggtcagccggcagtggatcgtggggacaggtaattcagtcctcacatcagcagcctgcagcctgacgtatttcgactaacttactactcgacctaagtcgactaaataataatctaagtttacggacgggtaacgggaccgtaagggtaggtaaacgattaacgaaaaccggtaacgtggtacggtccgtacggaacctaccgtagttcctacgttacctttacgtactttccccg

SEQ ID NO: 400769 - DNA, 527 bp, Homo sapiens
  misc_feature: GZ8MTXP02FTKY7.15.28.C06.1.454.CMB.2.raw
  modified_base (517)..(517): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaaagccccaaaaagtcctgatctctgccgcctctactttgcaaaagtggggtcccatcaaggttcagccggcagtggatctgggacagaattcagtctcaccatcagcagccctagcagcctgaacgtattttgactaaactttactactcgacccaaagttgacaataaataatcatttcggacggtagggaccgaaagggtggagagtacaaaacgaactgtacggctggcgaccatccgttntcttacactc

SEQ ID NO: 400770 - DNA, 554 bp, Homo sapiens
  misc_feature: GZ8MTXP02G8FJI.15.28.C06.1.454.CMB.2.raw
  modified_base (301)..(301): a, c, t, g, unknown or other
  modified_base (351)..(351): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttatggatgacttgggtccnccaggctccaggggaaggggctgggagtgggtggccaccataacaaaagntggaagtgaccacaacctatgtagaactctgtgatgggccgtattcaccgtctccagacgacgacgccaaagactcactacatctgacaaatgaacactgagagccgagacacggctgtagtattactgtgtagagagtatcgttactggtcggttcgggggaccctaacggggaaccccgtgggtaccacccggttctcccg

SEQ ID NO: 400771 - DNA, 533 bp, Homo sapiens
  misc_feature: GZ8MTXP02H14F2.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtcctgcatctgtaggagacagagtcaccatcacttgccgggccagtcagagtattactaaatggttggcctggttcagcagaaaccagggaaagaccccaaaagtcctagatctctgccgcctctactttgacaaaggtcggggtccatactaaggttcaggccggcaggtggatcgtggggacagaattcacgtcctacaccatcagcacgcctgcagcctgactatttgactaacttactactcgaccaagtcgactaataaatatctagttcggacggtagggacaaggtagagatacgaaaacgactggagactgaaccacctaatcttagtccttctacttcccg

SEQ ID NO: 400772 - DNA, 569 bp, Homo sapiens
  misc_feature: GZ8MTXP02GJF1J.15.28.C06.1.454.CMB.2.raw
  modified_base (372)..(372): a, c, t, g, unknown or other
  modified_base (458)..(458): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttatggatgacttgggtccgccaggctccgaggggaaggggctgggagtgggtggccaccatacaaaagatggaatgacacaacctangtgactctgtgatgggccgattccaccgtctccctcacgccctcccaccgaacggggccccagtccggtccttcccccgtggcccncccctgcctccgaggcgccaccgtccgagacgcacgacgccggcccgtggggcctcgcccgtcggtcaaacggtcctaccgttccgctacgtacgacctggacgcggggcg

SEQ ID NO: 400773 - DNA, 573 bp, Homo sapiens
  misc_feature: GZ8MTXP02HYIK0.15.28.C06.1.454.CMB.2.raw
  modified_base (351)..(351): a, c, t, g, unknown or other
  modified_base (370)..(370): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggcctggttcagcagaaaccagggaaagccccaaaagtcctgatctctgccgcctctactttgcaaagtggggtcccatcaaggtcagccgcagtgatctgggacngaattcagtctcacatcancagcctgcagcctgacgtatttgactaacttactactgacctaagttgacaaataaataactctagtttcgggacggtaaggggaacccaaggggttacgggaagtacttaacgaaaacggtaaaccgttaggtacggggtacttacggaaccctaaacccgtaacttccgttacggtttcctttaccgtaacgtttcccccg

SEQ ID NO: 400774 - DNA, 538 bp, Homo sapiens
  misc_feature: GZ8MTXP02HV7MN.15.28.C06.1.454.CMB.2.raw
  modified_base (269)..(269): a, c, t, g, unknown or other
  modified_base (349)..(349): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaaatggtggcctggttcagcagaaacaggaaanccccaaaaagtcctgatctctgccgcctctactttgcaaaagtggggtcccatcaaggtcagcggcagtgatctgggacngaaattcagtctcaccatcaagcagcctgcagcctgacgattttgctaaacttactaacctgccaaagttgacaataataatacaagtttcgggacggaggggaaccaaaggggttcggaagagtaacaaaacggtaactagtaggacctggaaccaaccaattcctagttcctttacaactttccccg

SEQ ID NO: 400775 - DNA, 751 bp, Homo sapiens
  misc_feature: GZ8MTXP02G8CBH.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccacccctgtctgcatcgtggtcggagacagacgtaccacctatctacgttcggcccggaccagtacagtagttaattaactaaagttgggttcggtccgttggttacacgacgaaacggaaaccggaagggaaacccgaaccccgtaaaacgtccgtagtactcctcgtccgccccgtccttacctttacgtttcgaacgtaaacgggttccgggtaccctagtacgtaacggttacgacggcccggacgtaggtaggacttcggtacgggaactaggttaacttacgtacgttcctacccaacctacgtaccaacgaccaccggtccctacggaccgtaccggtcccgttacggtaaccgtttacgttttaccgaaccttaaaccgtttaacctaccgttaccgaacccgttaaggtcctaacttaaattaaacttaacttacgttaacggtttaccggggacgggtaaacggggaaccgtaaggggtacggaaagtaacgtaaccgaaaacggtacgtcgggtacggtactacgaaccctacgtacgttacgtctttacctactacctttccccg

SEQ ID NO: 400776 - DNA, 515 bp, Homo sapiens
  misc_feature: GZ8MTXP02FZQZ9.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccagggaaagccccaaaagtcctgatctctgccgcctctactttgcaaagtggggtcccatcaaggttcagccggcagtggatctgggacaggaattcagtctcaccatcagcagcctgcagcctgacgtattttgacaacttactactgccaaagtgacaataaataaatcagtttcgggcggtaagggaccgaaggtaggagaatacgaaaacgacgtgtacggctgcaaccatctgtctcacttcccg

SEQ ID NO: 400777 - DNA, 516 bp, Homo sapiens
  misc_feature: GZ8MTXP02J0PTZ.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggtcagccggcagtggatcgtgggacagaattcagtctcaccatcagcagccctgcagcctgacgtattttgactaacttactactgaccaagttgacaataataatcatttcgggacggtagggaccaagggtggaagatacaaacgacgtgtacggctgaacacgactctgtcttcactttcccg

SEQ ID NO: 400778 - DNA, 523 bp, Homo sapiens
  misc_feature: GZ8MTXP02IVZN8.15.28.C06.1.454.CMB.2.raw
  modified_base (357)..(357): a, c, t, g, unknown or other
  modified_base (425)..(425): a, c, t, g, unknown or other
  modified_base (449)..(449): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaagaccccaaaagtcctgatctctgccgcctctactttgacaaagtcgggtcccatcaaggttcagccggcagtggatcgtgggacngaattcagtcctcacatcagcagcctgcagcctgacgtatttgactaacttactaactgaccaaagtnacaataaataatctagtttcgggnggaagggaccgtaaagggtacggaagaatacgaaaacgacgtaggtggctgaacaccatctgtcttctacttcc

SEQ ID NO: 400779 - DNA, 512 bp, Homo sapiens
  misc_feature: GZ8MTXP02GIMMQ.15.28.C06.1.454.CMB.2.raw
tcagtctacgtagccacgaccggtgctcgatttagagctcacgtattgggtttgggggaatcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaacaggaaagaccccaaaagtcctgatctctgccgcctctactttgcaaagtcggggtcccatcaaggttcagccggcagtggatcgtgggacagaattcagtctcacatcagcagctgcagcctgacgtattttcgactaacttactactgaccaagtgacaataaactaatcagtttcggacggagggaccgaaggtggagatacgaaaacgaactgtacggctagcacctatctgtcttcactttccc

SEQ ID NO: 400780 - DNA, 519 bp, Homo sapiens
  misc_feature: GZ8MTXP02IZC1F.15.28.C06.1.454.CMB.2.raw
  modified_base (427)..(427): a, c, t, g, unknown or other
  modified_base (510)..(510): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgcaaaagtggggtcccatcaaggttcagccggcagtggatcgtgggacaggaattcagtctcaccatcagcagcctgcagccctgacgtattttgactaacttactactgaccaagtnactaataaataatcagtttcggacggtaagggaccaagggtggaagatacaaaacgactgtacggctagcctaccatccgttntctcactcc

SEQ ID NO: 400781 - DNA, 520 bp, Homo sapiens
  misc_feature: GZ8MTXP02G845R.15.28.C06.1.454.CMB.2.raw
  modified_base (424)..(424): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccaggaaagccccaaaagtcctagatctctgccgcctctactttgcaaagtgggtcccatcaagtcagcgcagtgatcgtgggacagaattcagtctcacatcagcagcctgcagcctgacgtattttgactaaactttactacttgaccctaaaggtnactaataaattaaatctaagtttcgggacggaagggaaccaagggtacggagatacgaaaacgaactggtggctagcacatctgtcttcatttccc

SEQ ID NO: 400782 - DNA, 521 bp, Homo sapiens
  misc_feature: GZ8MTXP02GLTCI.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaagtcctgatctctgccgcctctactttgacaaagtggggtcccatcaaggttcagccgcagtggatcgtgggacagaattcagtctcaccatcagcagccctgcagccctgacgtattttgactaaacttactactgaccctaaagtgacataaataatctaagtttcgggcggtaggaccgaagggtggagatacgaaaacgactgtcggatgaacaccatctagtcttcactttccc

SEQ ID NO: 400783 - DNA, 509 bp, Homo sapiens
  misc_feature: GZ8MTXP02FOJST.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtatactaatggttgctgttcagcagaacaggaaagccccaaaagtcctgatctctgccgcctctactttgcaaagtcgggtcccatcaaggtcagccggcagtggatctagggacagaattcagtctcaccatcagcagcctgcagcctgacgtattttgactaacttactactgaccaagtgacaataaactaattcaagtttcgggacggaagggaccaaagggtggagagtacgaaaacgtactagtacggctagcaccatctgtcttacattccc

SEQ ID NO: 400784 - DNA, 557 bp, Homo sapiens
  misc_feature: GZ8MTXP02HQK75.15.28.C06.1.454.CMB.2.raw
  modified_base (353)..(353): a, c, t, g, unknown or other
  modified_base (374)..(374): a, c, t, g, unknown or other
  modified_base (380)..(380): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagatatactaaatggtgctgttcagcagaacaggaacgacccaaaagtcctagatctctcgccgcctctactttgactaaaggtcggggtacccagtctaaggttcagccggcagtgatgtggacngtaattcagtctacacatcancagctncagcctgacgttatttacgactaaacttactactgacctaagtcgactaataactaacgtctaagtttcgggacggtaacgggtaaccgtaagggtaggaaacgagtaaccgaaaacggtaacgtagacggtaccgtaggaacaaccgtacgttctacgtaccttacactttccccg

SEQ ID NO: 400785 - DNA, 604 bp, Homo sapiens
  misc_feature: GZ8MTXP02H0G3N.15.28.C06.1.454.CMB.2.raw
  modified_base (353)..(353): a, c, t, g, unknown or other
  modified_base (425)..(425): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggctggttcagcagaaaccaggaaagaccccaaaagtcctagatctctgccgcctctactttgacaaagtcgggtcccatcaaggtcagcgcagtgatcgtgggacngattcagtctcaccatcagcacgctgcagcctgacgtatttcgactaacttactacttcgacctaaaggttntactaaattaaacgtaacgttacgttaacggtttaccggggaacggggtaaacgggtaaaccggtaaaggggtacggaaaaggtaaaccgtaaacgaaaacggtaacgttacgggtacggtaccgtacgaaccgtaccttaacgttccgttacgtttacctttacctaccgtttacccg

SEQ ID NO: 400786 - DNA, 558 bp, Homo sapiens
  misc_feature: GZ8MTXP02FWCKG.15.28.C06.1.454.CMB.2.raw
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccggggggtccctgagactctcctgtgaagcctctggattcaccttgagcacttatggatgacttgggtccgccaggctccgaggggaaggggctggagtgggtggccacataacaaaagatggaagtgacacaacctatgtgactctgtgatgggccgattcaccgtctcctcacgccctccaccgaacgggcccagtccggtcctcccccgtggcccgccctcgcctccgaggacgccaccgtccgagacgccacgacgccggccctgggctcgcccgtggccaaacggcctaccttccgctacgtacgactggacgcgggtcg

SEQ ID NO: 400787 - DNA, 519 bp, Homo sapiens
  misc_feature: GZ8MTXP02HXKGA.15.28.C06.1.454.CMB.2.raw
  modified_base (351)..(351): a, c, t, g, unknown or other
tcagtctacgtagccacgaccggtgctcgatttagagctcacgtattggggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggtgctggttcagcagaacaggaaagccccaaaagtcctgatctctgccgcctctactttgcaaagtggggtcccatcaaaggttcagtccggcagtggatctgggacngaattcagtctacacatcagcagcctgcagctcgacgtatttgtactaacttaactacttacgtactaacgtagtacaataataaatactagttacggtacggaggaccgaaggtaggagagtacaaacgaaactacgtagcgtgcgacactctctcttctacttccg

SEQ ID NO: 400788 - DNA, 570 bp, Homo sapiens
  misc_feature: GZ8MTXP02ILKV4.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagatattactaaatggttggcctggttcagcagaacaggaaagcccaaaagtcctagatctctgcccgcctctactttgacaaaagtggggtacccatcaaggttcagccggcagtggatcgtggggacagaattcaagtctacacatcagcagccctgcagcctagaccgtattttgactaacttactacttgacctaagtgacaataaataaatctaagtttcgggacgggtaaggggaaccaaaggggtcggaaggtaactaacgaaaacggtaaacgtggtacggtacctaggaaccctacgtaacgttctacggtttccctttactaacctttccccg

SEQ ID NO: 400789 - DNA, 527 bp, Homo sapiens
  misc_feature: GZ8MTXP02GRQHB.15.28.C06.1.454.CMB.2.raw
  modified_base (430)..(430): a, c, t, g, unknown or other
  modified_base (514)..(514): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctagatctctgccgcctctactttgcaaaagtggggtcccatcaaggttcagccggcagtggatctgggacagaattcagtctcacatcagcagcctgcagccctgacgtattttgactaaacttactactgaccctaaaggtnacaataaactaatctaatttcggacggtaagggaccaagggtcggaagaatacaaaacgtaactggtacgctagcaccattctntcttcactttccc

SEQ ID NO: 400790 - DNA, 543 bp, Homo sapiens
  misc_feature: GZ8MTXP02G23VX.15.28.C06.1.454.CMB.2.raw
  modified_base (420)..(420): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtatactaaatggttggctggttcagcagaaccaggaaagccccaaaagtcctgatctctgccgcctctactttgcaaagtggggtccatacaggttcagccggcagtcggatcgtagggacagaattcagtctcaccatcagcagcctgcagcctgacgtatttacgctaacttactactgaccaagtnactaataaacttaactcgtaatttcggggacggaacggggaaccgaagggtacggaagacttaacgaaaacgtacgtaggtacggacttacgaacgacctaatctacgtccttcactttcccg

SEQ ID NO: 400791 - DNA, 533 bp, Homo sapiens
  misc_feature: GZ8MTXP02GISLA.15.28.C06.1.454.CMB.2.raw
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgcctggttcagcagaacaggaaagaccccaaaagtcctgatctctgccgcctctactttgcaaagtcggggtccatcaaggtcagccggcagtggatcgtaggggacagaattcagtctacaccatcagcacgctgcagcctgacgtattttgactaacttactactgacctaaagtgactaataaataatctagtttcgggaggaagggaccgaaagggtggaagataacgaaaacgacgtagtacggctaggaaccaacctagtctagtcttactactttcccc

SEQ ID NO: 400792 - DNA, 603 bp, Homo sapiens
  misc_feature: GZ8MTXP02G3H6F.15.28.C06.1.454.CMB.2.raw
  modified_base (390)..(390): a, c, t, g, unknown or other
tcagtctacgtagccacgaccggtgctcgatttagagctcacgtattgggtttgggggagtcagactcagtcaggacacagcatggacatgacgggtccccgctcagctccgtggggctcctgctgctctggctcccaggtgccaaatgtgacatccagatgacccagtctccgtccaccctgtctgcatctgtcggagacagagtcacatcacttgccggcagtcagatatactaatggtgctgttcagcagaacgaggaacacccaaaagtcagatctctcgccgcctctactttgactaaaagggtcgggtacccagtacgaaggttcaggccggcaggtgatcgtagggaacaggtaattcgaagtcctacaccatcagcagtccngcacgtctagacgttattacgacttaacttactacgtacgacgtaagtacaactaaataaactaacgtacgtaacggttacggggaacgggtaacgggtaacgtaaggggtacggaaacgtaaacgtaaacgaaaacggtacgtacggtacggtacgtacgtaaccgtaaccgttacgttacgttacgtttaccgttacctaccgtttccccg

SEQ ID NO: 400793 - DNA, 527 bp, Homo sapiens
  misc_feature: GZ8MTXP02F476I.15.28.C06.1.454.CMB.2.raw
  modified_base (427)..(427): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccggccagtcagagtattactaatggttggcctggttcagcagaaaccagggaaagaccccaaaagtcctagatctctgccgcctctactttgactaaagtggggtcccatcaaggttcagccggcagtgatcgtggggacagaattcagtctcaccatcagcagcctgcagcctgacgtattttgactaacttactactcgaccaagtnactaattaaataacttcgagtttacgggacggtagggacctaagggtcggaagatacgaaaacgacgtgtacggctgcaccatctgtctacactttcccg

SEQ ID NO: 400794 - DNA, 510 bp, Homo sapiens
  misc_feature: GZ8MTXP02IEBWN.15.28.C06.1.454.CMB.2.raw
  modified_base (356)..(356): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattaactaaatggttggcctggttcagcagaaaccagggaaaagccccaaaaagtcctgatctctgccgcctctacttttgcaaaagtggggtccatcaagttcagccgcagtgatctgggacngaattcagtctcaccatcagcagcctgcagcctgacgtattttgcaacttactaactgaccaaagtgacaataaataaatcaatttcggaggagggaccgaaaggtggaagagtacaaaacgaactgtaggctgcacatctgtcttacattccc

SEQ ID NO: 400795 - DNA, 530 bp, Homo sapiens
  misc_feature: GZ8MTXP02G4RSN.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtattactaaatggttggcctggttcagcaagaaaccagggaaacgaccccaaaagtcctgatctctgccgcctctactttgcaaagtggggtccatcaaggtcagccgcagtgatcgtgggacagaattcagtctcacatcagcagcctgcagcctgacgtattttgacctaacttactacttacgacctaagttcgactaataataaatctaagtttcggacggaagggacctaagggtacggaagagtaacaaacgtaacgtgtacggctagcacctagtcttgtcttcactttccc

SEQ ID NO: 400796 - DNA, 512 bp, Homo sapiens
  misc_feature: GZ8MTXP02GTCV6.15.28.C06.1.454.CMB.2.raw
  modified_base (358)..(358): a, c, t, g, unknown or other
  modified_base (426)..(426): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctagatctctgccgcctctactttgcaaagtggggtcccatcaaggttcagccggcagtggatcgtgggacngaattcagtctcaccatcagcagcctgcagcctgacgtattttgctaaactttacacttgccaaagtnacaataaactaatcagtttcggacggaagggaccaagggtggagatacaaagaacgtgtaggctgcaccatctgtcttcatttccc

SEQ ID NO: 400797 - DNA, 513 bp, Homo sapiens
  misc_feature: GZ8MTXP02IJQJ7.15.28.C06.1.454.CMB.2.raw
  modified_base (271)..(271): a, c, t, g, unknown or other
  modified_base (501)..(501): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaaatgtgacatccagatgacccagtctccgtccaccctgtctgcatctgtcggagacagagtcaccatcacttgccgggcagtcagagtattactaaatggttggctggttcagcagaaacaggaaanccccaaaagtcctgatctctcgccgcctctactttgcaaaagtgggtcccatcaaggttcagccgcagtggatctgggacagaattcagtctcaccatcagcagcctgcagcctgacgtatttgctaaacttactactgacctaaagtgacaataataaatcaagtttcggacggagggaccaaagggtcggaaagagtacaaaacggaactgtagctgaacaccatctntctactactccg

SEQ ID NO: 400798 - DNA, 527 bp, Homo sapiens
  misc_feature: GZ8MTXP02FRYOC.15.28.C06.1.454.CMB.2.raw
  modified_base (358)..(358): a, c, t, g, unknown or other
tcagtctacgtagccacgaccggtgctcgatttagagctcacgtattggggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggcagtcagagtattactaaatggttggcctggttcagcagaaaccaggaaagccccaaaagtcctgatctctgccgcctctactttgcaaaagtcggggtcccatcaaggttcagccggcagtggatctggggacngaattcagtctcaccatcagcagccctgcagcctgacgtattttgactaacttactactgaccctaagtgacaataaactaatactaagtttcgggcggtaaggggaccaagggtacggagatacgaaaacgaactgtacggctaggcaccatctgttctctacttccc

SEQ ID NO: 400799 - DNA, 513 bp, Homo sapiens
  misc_feature: GZ8MTXP02JAC2X.15.28.C06.1.454.CMB.2.raw
  modified_base (197)..(197): a, c, t, g, unknown or other
  modified_base (401)..(401): a, c, t, g, unknown or other
  modified_base (424)..(424): a, c, t, g, unknown or other
  modified_base (502)..(502): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganacagagtcaccatcacttgccgggccagtcagagtattactaatggttgcctggttcagcagaaccagggaaacaccccaaaagtcctgatctctgccgcctctactttgcgtaaaaggtcggggtcccactcgtaaggtcagccggcagtgatcgtggacagaattcagtctcacatcagcagcctgcagcctgacgtatttnactaactactactgaccagtcgntaataaatatctagtttcggcgggtaggacctaagggtcggagaatacgaaaacgactggtacgctagcaactctctntctctactccg

SEQ ID NO: 400800 - DNA, 584 bp, Homo sapiens
  misc_feature: GZ8MTXP02GLXIG.15.28.C06.1.454.CMB.2.raw
  modified_base (305)..(305): a, c, t, g, unknown or other
  modified_base (353)..(353): a, c, t, g, unknown or other
  modified_base (480)..(480): a, c, t, g, unknown or other
tcagtctacgtagccacgaccggtgctcgatttagagctcacgtattgggtttggggaggtctcagagaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccggggggtccctgagactctcctgtgaagcctctggattcaccttgagcacttatggatgacttgggtccnccaggctccgaggggaaggggctggagtgggtggccacatacaaaagntggaagtgacacaacctatgtgactctgtgatggggccattcaccgtctccctcacgccctcccaccgaacgggccccaagttccgggtccttccccccgtggcccgcccctcgcctccgagggacnccaccgtccgagacgccacacggccggccccgtggggcctcggcccgtgggtaccaaacgggcctaaccgtcccgactaacgtacgaccgtggacggcgggcgg

SEQ ID NO: 400801 - DNA, 518 bp, Homo sapiens
  misc_feature: GZ8MTXP02FN1VK.15.28.C06.1.454.CMB.2.raw
  modified_base (349)..(349): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaagtcctgatctctgccgctctactttgcaaagtggggtcccatcagttcagccgcagtgatctggacngatcagtctcacatcagcagcctgcagcctgacgtatttgactaacttactactgaccaaagtgacaataaattaatctaagtttcgggacggaagggaccgaaagggtggaaacgataacgaaaaccggaacgtgtacggctagcactactctgtcttcactttcccc

SEQ ID NO: 400802 - DNA, 559 bp, Homo sapiens
  misc_feature: GZ8MTXP02F1O30.15.28.C06.1.454.CMB.2.raw
  modified_base (360)..(360): a, c, t, g, unknown or other
  modified_base (372)..(372): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaaagtcctagaatctctgccgcctctactttgcaaaagtggggtcccatcaaaggttcagccggcagtggatctgggacngaattcagtctnaccatcagcagcctgcagcctgacgaattttgactaaacttaacctacgtgaccctaaaggtcacaataaataaatactaatttacgggaccggagggaaccgaaaggtacgggaggaagttaacaaaaccgaaacgtacgttacgggaacgttacgaacgactactactacgtacttactactccg

SEQ ID NO: 400803 - DNA, 573 bp, Homo sapiens
  misc_feature: GZ8MTXP02G02OS.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaacgaccccaaaagtcctgatctctcgccgcctctactttgactaaagtcggggtccatcaaggttcagccggcagtggatcgtgggacagaattcagtctcacatcagcagcctgcagcctgacgtattttgactaacttactactgacctaagtgactaataataatctaagtttcgggacgggtaacggggaaccgtaaaggggtacgggaagtacgttaaacgaaaacggtacgttagggtacggacgttaggaaccgtaaccgtaacttccttggttacctttacgtactttccccg

SEQ ID NO: 400804 - DNA, 524 bp, Homo sapiens
  misc_feature: GZ8MTXP02JHZ9C.15.28.C06.1.454.CMB.2.raw
  modified_base (424)..(424): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttgctggttcagcagaaaccagggaaacgaccccaaaagtcctgatctctgccgcctctactttgacaaagtggggtcccatcaaggtcagccggcagtgatcgtgggacagaattcagtctcaccatcagcagcctgcagctgacgtatttgactaacttactacttcgcctaaaggtnactaataattaactactagtttcgggacggtaagggaccgaagggtcggaagactacgaaaacgactgtacggctagcaccatctgtcttcactttcccg

SEQ ID NO: 400805 - DNA, 556 bp, Homo sapiens
  misc_feature: GZ8MTXP02F8002.15.28.C06.1.454.CMB.2.raw
  modified_base (353)..(353): a, c, t, g, unknown or other
  modified_base (418)..(418): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagccccaaaaagtcctagatctctgccgctctactttgcaaaagtgggtcccatcaagttcagcgcagtggatctgggacngaattcagtctcaaccatcagcagcctgcagcctgacgattttgacaattactactgccaaagtnacaataaataatactacgttcgggacgggaacgggaaccgaaagggtacggaagaaacgtaacgaaaacggtaaacgtacggtacggacgtacgaaccgaacctaacttccgttacgttaccttacctaacgttcccg

SEQ ID NO: 400806 - DNA, 639 bp, Homo sapiens
  misc_feature: GZ8MTXP02HGAC1.15.28.C06.1.454.CMB.2.raw
  modified_base (524)..(524): a, c, t, g, unknown or other
  modified_base (591)..(591): a, c, t, g, unknown or other
  modified_base (630)..(630): a, c, t, g, unknown or other
tcagtctacgtagccacgaccggtgctcgatttagagctcacgtattgggtttggggtcagagaggagccttagccctggactccaaggcctttccacttggtgatcagcactgagcacagaggactcaccatggaattggggctgagctgggttttcctgttgctattttagaaggtgtccagtgtgaggtgcaactggtggagtctgggggaggccctcgtccgagggccgggggtcctgacgactcctcgtgtagacgcctcgtggtacttccaccgttgacgactactttagtggatgtacggttcggggtccccacgacggtcctaccggaagggggacggggtcgtaggggagggttggggtccggacccaaccgtaaacgtaaaacgaaaaaaggtgtaaggggtaaagtacgaaacccctaaacctaaaccttagtagtacgtaacttcgtgtacgtaggtcgggcctacttcgaccgtcacgagacgacgacgacaagactcaactacactcganaacaaatacgaaaccactgaacggacgcgaacggtacgaggtctagtagtatacgtgtgtgagagtntcgtgtcggtcgggtcggaccgacggtaccgtcgtaccnccgtctccg

SEQ ID NO: 400807 - DNA, 537 bp, Homo sapiens
  misc_feature: GZ8MTXP02HWVA0.15.28.C06.1.454.CMB.2.raw
  modified_base (269)..(269): a, c, t, g, unknown or other
  modified_base (357)..(357): a, c, t, g, unknown or other
  modified_base (378)..(378): a, c, t, g, unknown or other
  modified_base (384)..(385): a, c, t, g, unknown or other
  modified_base (387)..(387): a, c, t, g, unknown or other
  modified_base (389)..(389): a, c, t, g, unknown or other
  modified_base (428)..(428): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtatactaaatggtgctggttcagcagaacaggaaanaccccaaaagtccagatctctgccgcctctactttgactaaaggtcggggtcccatctaaggttcaggccggcagtgatcgtgggacngaattcagtctcaccatcgancacgcnncncnctcgtacgtattgtactaacttactactacgactagtanactataataatactagtacggtacggacgggaacggaaggtacggtagtaacgaacgaaacgtaacgtacgtacgtacgacgcgactactactcgttcttactactccg

SEQ ID NO: 400808 - DNA, 539 bp, Homo sapiens
  misc_feature: GZ8MTXP02H4X3Z.15.28.C06.1.454.CMB.2.raw
  modified_base (355)..(355): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggccagtcagagtatactaaatggttggcctggtttcagcagaaaccaggaaacgaccccaaaagtcctgatctctgccgcctctactttgcaaagtggggtcccatcaaggtcagccgcagtgatctgggacngaattcagtctcaccatcagcagcctgcagcctgacgtatttgctaacttactacttcgacctaaagttgactaataaataatactagtttcgggacgggagggaaccgaaagggtggagtaatacgaaaacgtaacgtgtacggctaggaaccaccaattcctagttcctttcaactttcccg

SEQ ID NO: 400809 - DNA, 565 bp, Homo sapiens
  misc_feature: GZ8MTXP02IB0Z6.15.28.C06.1.454.CMB.2.raw
  modified_base (198)..(198): a, c, t, g, unknown or other
  modified_base (496)..(496): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcgganacagagtcaccatcacttgccgggccagtcagagtatactaaatggtgcctggtcagcagaacgaggaacaccccaaaagtcctagatctcgtcgccgccttactactttgacgtaaaggtcggggtaccatacgtaaaggtcagccgcaggtgatcgtagggacagtaattcacgtcctacaccatccagcagtcctgacagcctagacgttatttcgactaacttactactcgacctaaagtcgactaataaactaatctagttcgggacggaacggacgaagggtacgaaggtanaactaaaacggaactggtacggtctacgaaccgaacctattccgtagtttccttactaacgtttccccg

SEQ ID NO: 400810 - DNA, 534 bp, Homo sapiens
  misc_feature: GZ8MTXP02GBZ59.15.28.C06.1.454.CMB.2.raw
  modified_base (359)..(359): a, c, t, g, unknown or other
  modified_base (383)..(386): a, c, t, g, unknown or other
  modified_base (388)..(388): a, c, t, g, unknown or other
  modified_base (398)..(398): a, c, t, g, unknown or other
  modified_base (417)..(417): a, c, t, g, unknown or other
tcagtctacgtagccacgaccggtgctcgatttagagctcacgtattgggtttgggggagtcgagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagaccccaaaaagtcctgatctctgccgcctctactttgcaaaagtggggtcccatcaaggttcagccggcagtgatctgggacngaatcagtctcacatcagcagccnnnncngacgtattanacactactactcacagtanacaataataatatacgttacggacggacgggaacgtaagggtacggagaacgtaacgaaaacgaaacgtacgtacggtacgtacgaacgacctactacgtcgttacttactactccg

SEQ ID NO: 400811 - DNA, 545 bp, Homo sapiens
  misc_feature: GZ8MTXP02F0RS0.15.28.C06.1.454.CMB.2.raw
  modified_base (358)..(358): a, c, t, g, unknown or other
tcagtctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaaccagggaaagaccccaaaaagtcctgatctctgccgcctctactttgcaaaagtggggtcccatcaaggttcagccggcagtgatctgggacngaattcagtctcacatcagcagcctgcagcctgacgtattttgactaacttactactgaccaagtgacaataaacttaaatactaacgtttcgggacggtacggggaaccgaaagggtacgggaagataacgaaaacgaaacgtacgtggactggccgaaaaactctactcgtcttcactttccccg

SEQ ID NO: 400812 - DNA, 563 bp, Homo sapiens
  misc_feature: GZ8MTXP02H4X4J.15.28.C06.1.454.CMB.2.raw
  modified_base (369)..(369): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctcccgtccaccctgtctgcatctgtcggagacagagtcaccatcacttgccgggcagtcagagtattactaaatggttggcctggttcagcaagaaaccgaagggaaacgaccccaaaagtcctagatctctgccgcctctactttgactaaaggtcggggtaccatcgaaggttcagccggcagtggatcgtggggaacnggaattcgacgtctacaccatcagcagcctgcagcctagacgtatttcgactaacttactactacgacctaagtagactaataaactaatactaagtttcggacgggaagggaaccaagggtggaagaatacgaaaacgtaaacgtcggtacgactagccgtaaccacttcgtacgttacttactaacttcccg

SEQ ID NO: 400813 - DNA, 544 bp, Homo sapiens
  misc_feature: GZ8MTXP02IU8BK.15.28.C06.1.454.CMB.2.raw
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggttcagcagaaacaggaaagaccccaaaagtcctgatctctgccgcctctactttgacaaagtggggtcccatcaaggttcagccggcaggtgatcgtagggacagaattcagtctcacatcagcagcctgcagcctgacgtatttcgactaacttactactcgaccaagtcgactaaataataatactagtttcgggacggaagggtaccaaaggggttggaagtaacgtaacgaaaaccggaactggtcggacctaggaaccaccattcctagtcttaccgacttccccg

SEQ ID NO: 400814 - DNA, 543 bp, Homo sapiens
  misc_feature: GZ8MTXP02IASQ3.15.28.C06.1.454.CMB.2.raw
  modified_base (433)..(433): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattacaaatggtggcctggttcagcagaaacaggaaacgaccccaaaagtcctagatctctcgcccgcctctactttgacaaaagtcggggtcccatcaaaggttcagccggcagtgatcgtggggacagaattcagtctacaccatcagcagcctgcagcctgacgtatttgacctaacttactactcgactaaagtcanaaattaaataattacgagtttcgggacggaaggggaccaaagggtacggagataaactaaacgaaacgtggtacgcgtgaaccgactactcttagtccttactacttccc

SEQ ID NO: 400815 - DNA, 766 bp, Homo sapiens
  misc_feature: GZ8MTXP02GZ1FR.15.28.C06.1.454.CMB.2.raw
  modified_base (197)..(197): a, c, t, g, unknown or other
tcagtctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcgganaccagagtcaccatcacttgccggccagtcagagtattactaatggtgcctggttcagcagaacaggaacaccccaaagtcctagatctcgtcgccgtcctactacgtttcgacgtaaaacgggttcggggtaccctacgtacgtaaacggttccacggccccggtacgtaacggtcgggtaaacgttccggttaaggggaaacctaagggttaaacctttccgtaaaccggtttccctaacccgaacccgtaacttaccgaaacgtcccgtaaaccggtcccccgtaggacccgaaacgggtccccgttagggtaacggtttaactttttaggacccttaaacgtttaaccgtaaacctcggtaaccctaaggtacgtacttaaaattaaacgttaacttacgtaacgtttacggggacgggtaaacggggaaccgtaaagggggttacggaaaagtacgttaaaccccggtaaaaggaaaccgttagggttccgggaaccttcgggaacccgtaaccccgtaagtttacccgtacgtttccttttaaccccgtacccgtttaccccg
